United States Patent 9,782,462 (MODIFIED POLYNUCLEOTIDES FOR THE PRODUCTION OF PROTEINS ASSOCIATED WITH HUMAN DISEASE) - sequence listing, part 15

SEQ ID NO: 16248 - DNA, 5580 bp, Homo sapiens
aacaggtaatgtttaacgtgccagtcacaaagatcacagaaacagtgtatgcccgggcataagatagcacgactgtgtatgctctggaggactgaaaggctgtacaagccctatgtattttttttcaaatatacatatgcatgggtcttgctgctgcctcttttgctgactgtaattggactttgaagcttcgaagttatatcataaaaatttgtaacctttgtctgagagagagctcagctaagcaatcactttccacttcttttcacaggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagtaatcagaggaggatttggggcaccaatgtggagaactggccaactgtacaaggaacttcaaagtcctcttgttatttggaagaggaaaaagcaaagacaagaagcatacccaacattgtaaaggatgatctttatgtgcgcaagctcagtccagtcatgccaaacccagggaatgcttttgatcagtttcttcccaaatgttggaccccagaagatgtgaactggaaaagaataaaaagggaaacttataagccatggtataaagaatttcagggattcagtcagtttttactgcttcaggccctccaaacatactctgatgacatcttgtcttctgaaacacataccaaaattgatcccacttctggcccaaggctcataacccgcaggaagaatctctcttatgcaccaggctatagaagagatgacctcgagatggcagccctggatcctgacttagagaatgatgatttctttgtcagaaagactggggctttccatgcaaatccatatgttctccgagcttttgaagactttagaaagttctctgagcaagatgattctgtagagcgagatataattttacagtgtagagaaggtgaacttgtacttccggatttggaaaaagatgatatgattgttcgccgaattccagcacagaagaaagaagtgccgctgtctggggccccagatagataccacccagtcccttttcccgaaccctggactcttcctccagaaattcaagcaaaatttctctgtgtacttgaaaggacatgcccatccaaagaaaaaagtaatagctgtagaatattagttccttcatatcggcagaagaaagatgacatgctgacacgtaagattcagtcctggaaactgggaactaccgtgcctcccatcagtttcacccctggcccctgcagtgaggctgacttgaagagatgggaggccatccgggaggccagcagacttaggcacaagaaaaggctgatggtggagagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacatgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcattt

SEQ ID NO: 16249 - DNA, 3706 bp, Homo sapiens
ggggtccggggcggggccgcaggagcagtaggtgttagcagcttggtcgcgacaggtgcgctaggtagagcgccgggacctgtgacagggctggtagcagcgcagaggaaaggcggcttttagccaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaa

SEQ ID NO: 16250 - DNA, 3669 bp, Homo sapiens
gcttggtcgcgacaggtgcgctaggtagagcgccgggacctgtgacagggctggtagcagcgcagaggaaaggcggcttttagccaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactccccaggtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaa

SEQ ID NO: 16251 - DNA, 2198 bp, Homo sapiens
ggatgctttctccatgtggcaaggctgtaactgttcacagctgtctgaaacagcagtggaccaggagcagcttggagttttaactttcattttacaaagaacaacatgtttgaatgtttcagcagaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatc

SEQ ID NO: 16252 - DNA, 3920 bp, Homo sapiens
tgggtcgtaatctagaataccatcactaggtgactaagtcatactcacattcctttcattgacctggtggccataaattgtttcctcccatgcctaaagattcacagagaacagaaaagtactagattactacattattagcagactaatggtgggaaatgtctatagtcatcgacctctatgtttattttattttattttatttttttattttgagatggagtttcactcttgttccccaggctggagtgcagtggcgtgatctcggctcactgcaacctctgcctccctgattcaagcgattctcctgcctcagcctcccaagtaactgggattacaagtgtgcaccaccacacgtggctaattttttgtatttttagtagagacaggatttcaccatgttcgccaggctggtcttgaactcctgacctcaggcgatccacccgcctcagcttcccaaagtgctgggattacaggcgtgagccactgcacccaggttctatgttgattttagatgtaatagatgagttaattgtaatattcaccccagtgtcctttgcaaggaaaaaaatgcaattatccttattccttatgacaataaaatgcatgttcttttatgttgaggctctgttttgagaagtaaaataaattatgtctttagtacaatatatgaattgtatatggaaaaacatgctttttgaaagtcccaccaaaaaggtttctttatggtatcattaaatataatttcagtttttatatgtatacatcatccctgtctctctttccaggccgggcatttatatatgtatggtcagtatattttctattattggcacttggcatctcctttcccctgctccagaatggtcttttctgataaaactcacaagctttgcattaccacaagctctgctgctagaagagtgaatcacaagaatgttgtatgcttggggtgttctgtgtgcctgtgttgatgtgtctgtattctaatgagcaatccagttttacactagcatacagatatttaactctgaggtatgtgtccacaaagctgcttttgtcatttcactagtcagtgggttttgcttgtgagagttagggggttgatttgacccgaggcttcttagaagaattttttaacattccaagtttatctaatagatgtgctatgaagagaacagaatgatgggactttaaaaaaatttttacagttatttttattttgtagaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaa

SEQ ID NO: 16253 - DNA, 567 bp, Homo sapiens
agatcagttatgctcttcggttgccaagagctgcaagtagtactttatttttcttttacttctggtaagctgtgaattagcagtactttattattatttttttttagttttcaagactcctggatcagaaacaaagtggtactttatatttttcactcttcaaataaggaaactgttgactcatttctaatctctcgtcttctggacaaaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccac

SEQ ID NO: 16254 - DNA, 583 bp, Homo sapiens
aggtagagcgccgggacctgtgacagggctggtagcagcgcagaggaaaggcggcttttagccagttttcaagactcctggatcagaaacaaagtggtactttatatttttcactcttcaaataaggaaactgttgactcatttctaatctctcgtcttctggacaaaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactca

SEQ ID NO: 16255 - DNA, 2652 bp, Homo sapiens
ataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaa

SEQ ID NO: 16256 - DNA, 3612 bp, Homo sapiens
ttcctgcttcagctcctgagtttttctctcttcccctctccctctccctctgccgggtggatgctttctccatgtggcaaggctgtaactgttcacagctgtctgaaacagcagtggaccaggagcagcttggagttttaactttcattttacaaagaacaacatgtttgaatgtttcagcaggcaagttataactggcatctacttcttgttcttctagaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactccccaggtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttg

SEQ ID NO: 16257 - DNA, 3254 bp, Homo sapiens
agaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaa

SEQ ID NO: 16258 - DNA, 2285 bp, Homo sapiens
gggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccccggcccagtggccattgtaactttcccccgggacagcggccgccgcggggcgggccgaggcagtgcgtgcgagtctttgtgcggccggcggactggagctcccagtcgggcctgcccgtcccactcgggacatgagctgctgaagttgtccccccgtcagccctcacccctgccaggactcctctgggcttgcagtcgctcccccgtacctctcctggccccctcagttctcccaggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagcgcatggtagcaccccctgcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggagggggtactcatgtggatgcctacttggaacctgggcctctgagacatgtcctgaccaccccccagggcatttgcctccatcttcaccccagattgtgggtttcccatccccctgactttacccctttcaagcctggggttgtctatacccacagcccttagggacttaaagttacggggcttcgttgaatgctccttcccctaggcagctggtaatagaggggtaaagctctgggcccctcctccctgctgccacttatcccagctccaagtttttttaaaaataatattattaaaaatgtaagttaaaaaaaaaa

SEQ ID NO: 16259 - DNA, 2089 bp, Homo sapiens
cgagggcggagaggggggcgctcggcgacggcggcgggagcgcacagacacgcacacgcacacgcgcacacacgcacacacggacacacactccgcggactcacacccgcgcgcacacacgcagaggccgctcgccttcctgcctggcttccttcctgtctgctccgcgcctgacaggcccctcgccgcagccaggggccgcccgcaccgggccgaggccgggccgggccggcggcgagcgcagcgggggccgcgggcggcggcggcggctcatgcccggcctgtccccgcgaggggcgggcaccgtgactcggctgggcccccagaggcgggcgatgtgaagatgtcagtgggctgtgcctgtcctggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagcgcatggtagcaccccctgcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggagggggtactcatgtggatgcctacttggaacctgggcctctgagacatgtcctgaccaccccccagggcatttgcctccatcttcaccccagattgtgggtttcccatccccctgactttacccctttcaagcctggggttgtctatacccacagcccttagggacttaaagttacggggcttcgttgaatgctccttcccctaggcagctggtaatagaggggtaaagctctgggcccctcctccctgctgccacttatcccagctccaagtttttttaaaaataatattatt

SEQ ID NO: 16260 - DNA, 2548 bp, Homo sapiens
ccctccctcccttcttccctcccttcctccataccaacctccctccctctctggagctcctgctctctccctctccctcctctcccgtgctccctccctccctccctctttccctccctcctctcctctccctctcctctcctgctatagagggctccgacagcagttcccagccagcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 16261 - DNA, 2476 bp, Homo sapiens
gtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgggctaggagcgatcccgaactgcagcctcaaccctgggagggatggagacctgtgtcattcaacagcagtgaccccttctggccaatttaaggagaagcattgaggggccctgaaaggagtcacttccagtcctcctcagaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 16262 - DNA, 2626 bp, Homo sapiens
agcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctattgctagcattgctcgttctccagtgtcaggctgcgcactaaggacataaactcgcgtggttgttacacatcaggaggcgatgtttatttcctgtagaaatcaaatatgcgtctcggcccccgacattgagacttgaccccgttgtacagtacacgagtgtgtctgtcctagattccccgactcctcccactgttattttaagctgagcttctctctcccaaggtttccctgtaataatgtcagctgctgttcacaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatga

SEQ ID NO: 16263 - DNA, 1108 bp, Homo sapiens
attcagcggcagatgccagaggaaactgcaaccagctcggggattcggaaccagatgcctgtgatggattattacaatttcctatcatgtaattgcttttctgtttgaccaaagctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctattgctagcattgctcgttctccagtgtcaggctgcgcactaaggacataaactcgcgtggttgttacacatcaggaggcgatgtttatttcctgtagaaatcaaatatgcgtctcggcccccgacattgagacttgaccccgttgtacagtacacgagtgtgtctgtcctagattccccgactcctcccactgttattttaagctgagcttctctctcccaaggtttccctgtaataatgtcagctgctgttcacaggatgtgatggtggtaggagagccaactctgatgggaggtgagtttggggacgaggacgaaaggctaatcactagattaga

SEQ ID NO: 16264 - DNA, 567 bp, Homo sapiens
gagggctccgacagcagttcccagccagcgtgttcagcctgcctgcctgcctgcctctgaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtcca

SEQ ID NO: 16265 - DNA, 1498 bp, Homo sapiens
agcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacattgtgcattcagcggcagatgccagaggaaactgcaaccagctcggggattcggaaccagatgcctgtgatggattattacaatttcctatcatgtaattgcttttctgtttgaccaaagctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctattgctagcattgctcgttctccagtgtcaggctgcgcactaaggacataaactcgcgtggttgttacacatcaggaggcgatgtttatttcctgtagaaatcaaatatgcgtctcggcccccgacattgagacttgaccccgttgtacagtacacgagtgtgtctgtcctagattccccgactcctcccactgttattttaagctgagcttctctctcccaaggtttccctgtaataatgtcagctgctgttcacaggatgtgatggtggtaggagagccaactctgatgggaggtgagtttggggacgaggacgaaaggctaatcactagattaga

SEQ ID NO: 16266 - DNA, 923 bp, Homo sapiens
tgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacagaaccaagaatttaagaccaattggggaaaaaatgaatattaatggaaaatgctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccg

SEQ ID NO: 16267 - DNA, 2295 bp, Homo sapiens
gggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 16268 - DNA, 4966 bp, Homo sapiens
aggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaaggaaaaaaaaaaaaaaacgttcccagaattcagtttccaaaatctctttttaaagggtttacacacacacacacacacacacacacacacacacacacacacacacacgatcattaaaaagtgtatgctctttaagaagaaaagtaaaatatctcaaaggacggtttcaccaccgtcctttattgaatcaatttttctacatttcagagcaagtgtagattctgagggactcctatttgccaaaaagacaaaactagcaaaaaaaaaacaaaaaaacaaaaaaaaaaccacttaaaaggtagcaggaaaagaaggtagttttgagtgtggttcactcagtgtctgtgagtctggtgtagtgtcaggagtaaggccgtgtctagctcaagtttacatttggatgtcctacaacactaaacaaaatttttcataatccatggtggggagcacactttggagctacatttcttgtctcctcattgttgacattaattaaacatttataggccaggcacagtggctcacgcctgttatcccagcactttgggaggccgaggcaggtgaatcacctgaggtcaggagtttgaaaccagcctggccaatatggtgaaaccccatctctactaaaaatacacaaaattagccaggtgtggtggcaggcgcctgtagttccagctacttgggaggctgaggcaggaatctcctgaatcctggaggcggaggttgcagtgagccgagattatgccattgcactccagcctgggcaacaggagcgaaactccgttgcaaaaaaaaaaaaaaaaaaaaaattataatcacaactttttgcaatggagtgacttatatctgcagcttatatctgcagtgtttgtgttaggaacctagcttttataatgtgttaactttttaactcagtattctggctttgggattttttgttttgtttttggaaacatttcagaagtggaatgtagcctgttaaaggtgtgcacaaaaatattttgcatgtgtttttttttttgcctgtgtgaattctactttttagcaaaaataaagccccccaaaggatgtgc

SEQ ID NO: 16269 - DNA, 1695 bp, Homo sapiens
aggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggagggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaagtgaaccacacca

SEQ ID NO: 16270 - DNA, 4650 bp, Homo sapiens
acagtccatttatgggcgcagccgaaggcagatatcagtgtcgatggcattcgctcccagctattcttaggagcctctcaagagctccacgcagcccggctgggcagcaagggacagaacagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaaggaaaaaaaaaaaaaaacgttcccagaattcagtttccaaaatctctttttaaagggtttacacacacacacacacacacacacacacacacacacacacacacacacgatcattaaaaagtgtatgctctttaagaagaaaagtaaaatatctcaaaggacggtttcaccaccgtcctttattgaatcaatttttctacatttcagagcaagtgtagattctgagggactcctatttgccaaaaagacaaaactagcaaaaaaaaaacaaaaaaacaaaaaaaaaaccacttaaaaggtagcaggaaaagaaggtagttttgagtgtggttcactcagtgtctgtgagtctggtgtagtgtcaggagtaaggccgtgtctagctcaagtttacatttggatgtcctacaacactaaacaaaatttttcataatccatggtggggagcacactttggagctacatttcttgtctcctcattgttgacattaattaaacatttataggccaggcacagtggctcacgcctgttatcccagcactttgggaggccgaggcaggtgaatcacctgaggtcaggagtttgaaaccagcctggccaatatggtgaaaccccatctctactaaaaatacacaaaattagccaggtgtggtggcaggcgcctgtagttccagctacttgggaggctgaggcaggaatctcctgaatcctggaggcggaggttgcagtgagccgagattatgccattgcactccagcctgggcaacaggagcgaaactccgttgcaaaaaaaaaaaaaaaaaaaaaattataatcacaactttttgcaatggagtgacttatatctgcagcttatatctgcagtgtttgtgttaggaacctagcttttataatgtgttaactttttaactcagtattctggctttgggattttttgttttgtttttggaaacatttcagaagtggaatgtagcctgttaaaggtgtgcacaaaaatattttgcatgtgtttttttttttgcctgtgtgaattctactttttagcaaaaataaagccccccaaaggatgtgcaaa

SEQ ID NO: 16271 - DNA, 4223 bp, Homo sapiens
gcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggagggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagcacccctattgagcatgcgccggtgtgcaccagccaggccaccaccccgctgctgcccgcttctgcccagccacctgctgctgcctctcccagtgcggcttcgccacccctggccacagctgctgcccacactgccatcgcctccgcctccaccacagcccctgcttcaagtcctgccgacagcccaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaagg

SEQ ID NO: 16272 - DNA, 1899 bp, Homo sapiens
aggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggaggcgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaagtgaaccacacca

SEQ ID NO: 16273 - DNA, 1598 bp, Homo sapiens
gcaggcggagtgcctgagtgccctctcactcaaccctctctaccctttgtctgcagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaag

SEQ ID NO: 16274 - DNA, 5436 bp, Homo sapiens
acagtccatttatgggcgcagccgaaggcagatatcagtgtcgatggcattcgctcccagctattcttaggagcctctcaagagctccacgcagcccggctgggcagcaagggacagaacagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggaggcgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaaggaaaaaaaaaaaaaaacgttcccagaattcagtttccaaaatctctttttaaagggtttacacacacacacacacacacacacacacacacacacacacacacacacgatcattaaaaagtgtatgctctttaagaagaaaagtaaaatatctcaaaggacggtttcaccaccgtcctttattgaatcaatttttctacatttcagagcaagtgtagattctgagggactcctatttgccaaaaagacaaaactagcaaaaaaaaaacaaaaaaacaaaaaaaaaaccacttaaaaggtagcaggaaaagaaggtagttttgagtgtggttcactcagtgtctgtgagtctggtgtagtgtcaggagtaaggccgtgtctagctcaagtttacatttggatgtcctacaacactaaacaaaatttttcataatccatggtggggagcacactttggagctacatttcttgtctcctcattgttgacattaattaaacatttataggccaggcacagtggctcacgcctgttatcccagcactttgggaggccgaggcaggtgaatcacctgaggtcaggagtttgaaaccagcctggccaatatggtgaaaccccatctctactaaaaatacacaaaattagccaggtgtggtggcaggcgcctgtagttccagctacttgggaggctgaggcaggaatctcctgaatcctggaggcggaggttgcagtgagccgagattatgccattgcactccagcctgggcaacaggagcgaaactccgttgcaaaaaaaaaaaaaaaaaaaaaattataatcacaactttttgcaatggagtgacttatatctgcagcttatatctgcagtgtttgtgttaggaacctagcttttataatgtgttaactttttaactcagtattctggctttgggattttttgttttgtttttggaaacatttcagaagtggaatgtagcctgttaaaggtgtgcacaaaaatattttgcatgtgtttttttttttgcctgtgtgaattctactttttagcaaaaataaagccccccaaaggatgtgcaaa

SEQ ID NO: 16275 - DNA, 5091 bp, Homo sapiens
acagtccatttatgggcgcagccgaaggcagatatcagtgtcgatggcattcgctcccagctattcttaggagcctctcaagagctccacgcagcccggctgggcagcaagggacagaacagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaaggaaaaaaaaaaaaaaacgttcccagaattcagtttccaaaatctctttttaaagggtttacacacacacacacacacacacacacacacacacacacacacacacacgatcattaaaaagtgtatgctctttaagaagaaaagtaaaatatctcaaaggacggtttcaccaccgtcctttattgaatcaatttttctacatttcagagcaagtgtagattctgagggactcctatttgccaaaaagacaaaactagcaaaaaaaaaacaaaaaaacaaaaaaaaaaccacttaaaaggtagcaggaaaagaaggtagttttgagtgtggttcactcagtgtctgtgagtctggtgtagtgtcaggagtaaggccgtgtctagctcaagtttacatttggatgtcctacaacactaaacaaaatttttcataatccatggtggggagcacactttggagctacatttcttgtctcctcattgttgacattaattaaacatttataggccaggcacagtggctcacgcctgttatcccagcactttgggaggccgaggcaggtgaatcacctgaggtcaggagtttgaaaccagcctggccaatatggtgaaaccccatctctactaaaaatacacaaaattagccaggtgtggtggcaggcgcctgtagttccagctacttgggaggctgaggcaggaatctcctgaatcctggaggcggaggttgcagtgagccgagattatgccattgcactccagcctgggcaacaggagcgaaactccgttgcaaaaaaaaaaaaaaaaaaaaaattataatcacaactttttgcaatggagtgacttatatctgcagcttatatctgcagtgtttgtgttaggaacctagcttttataatgtgttaactttttaactcagtattctggctttgggattttttgttttgtttttggaaacatttcagaagtggaatgtagcctgttaaaggtgtgcacaaaaatattttgcatgtgtttttttttttgcctgtgtgaattctactttttagcaaaaataaagccccccaaaggatgtgcaaa

SEQ ID NO: 16276 - DNA, 2463 bp, Homo sapiens
agaggcgagcttcatcaggcaggagccagaggccagagagacagcgtgcagctccagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggagggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgca

SEQ ID NO: 16277 - DNA, 1889 bp, Homo sapiens
atgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggagggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaagtg

SEQ ID NO: 16278 - DNA, 18278 bp, Homo sapiens
gtcacttttatttgggggtgtggacagctgctttcccaggggagtacttcttacagtgggatttcaagacaagatcggcctgaagaaaaattatatttgtatattttttaaaaagtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctagttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataactattgtattttcagaattttaacacagattaacacttagcctgtaagactaataatatattgtaatagttgatactaaaatatttttcagcaggttggacagcaccagtttttcttagatcacagactacaggcagaatttcccttcaatccagaaaaaaggacactaatttccttttctatttaattttcctggcccttgtgcaaaaaattgtggactctatcttagttacaacatgcatgtcccttattttgtggagagctgtgtgaaagatgcgttttttttctttttttcttttttttttttttgagacggagtctggctctgtcacccaggctggagtgcaatggcacgatctcctctcactgcaagctccgcctcccaggttcacgccattctcctgtctcagcctcccgagtagctgggactacaggcgcctgccaccacgcccggctaatttttttgtatttttagtagagatggagtttcacagtgttagccaggatggcctcgatctcctgacctcgtgatccacccgcctcggcctcccaaagtgctgggattacaggcgtgagccaccgtgccccgcgtgtttttttctttagctgattgacaggtccccttcaaagttacaaaaaaaagtgctaatttttgctgttaaattctggttgttatttaattgacagaagtctcttgatgcacgaataaatatctctacatctagcctttgttaaaaataaaaattaatattctacaaacacctacatatactagagaggggtgaaacactgcagctaattcctttataatactttcagatgattgcattaagcctttcatgttatgtggcattgttaatttttcctagatacccatccacttaagggccagagaaatccttattcatttaactctggtgggcatttatgtaacatacccaaataaaaacgttattaaacagccacaatcgcattcagtcaacttggcactgaatgtagcttctaaaatcagttctctaccctacgaatggaatgttctaccaagaaagagaagcatcaccatgtcatcttgtgttctacaccactatagagagttacagttgcccccaaacacgaatgctattcccaaataaaatagaatcatgctttgggaggccaaggcgggccgatcacgaggtcaggagatcgagaccatcctggctaacacggtgaaaccccgtctctactaaaaaaaaaaaaaaatacaaaaaattagcctggctcagtggcgggcgcctgtagtcccagctactcaggaggctgaggcaggagaatggcgtgaacccgggaagcggagctttcagtgagccgagatagcgccactgcagtccggcctgggcgaaagagcgagactccgtctcaaaaaaaaaaaaaaaaaaataggatcatggcccttttaaagatctgaatcttctctgttattttcctgatgaatcaccatcccatatcttcttagtcctggccagtatgtagttgcgctcacatacgtctattctagctctgtagctccacaaaacaagtcttaagtccaaatctttgcctcttcatgtctgatatcaccaactcattcagcttttcttcacttattgacatagtgtcatgtcctatcactctctgctgcttctttaaacagtggacacaaacatattttctaattttcagtgtactcagtgaaacttggcagttcaccatgagtcaggctaggttgaaaggctttctttagggttgaaagtaaacgaaattggaatcacccaaagagaatttccccaaaaaacctcagacccagaagtgtaaaagctacagaaggatagaactcccatgtctacagacagttctgttactttttgttctgtactattttggatgttgccaaaatcaaattcatcctgaaaacaggaagcaagctaatgcatatgccatccatgagattcccacttctgggtcagttcatattccattcaaccttttccttttatccttgtcttcttcagaataagacatttttcctccatattttcatattaaatattaacactttataggttctactttaatatatggacactttacaggttatacataaatatttgctggttgattgatttcgagattcattcattctgtgctcaaatatttgtacctagagacgttacatgttagaaaaagtgagcagcttctttctctaatcatttaggagtccatatttttcttttctttttgttctcccaacatccttatctcttactcagctcttcaatttataattaccaaataatcactgttagagaatcagcccctaagtaactttgattctggccaactgtaataagatccaaccacttaaatctgtacttactcaataggaaggaatgtgacatcaggaagagtcattccagtgacattagtaagactttatggagtacataaaatttgataagaaatcttgagctgattctttgacttgatttagaagttgagaaaagagtatttaaggcacaacagggaaacatgggctatactcagagaagaccctctgcattggccaaaatatcatggattctggaaattccttcttaacagaaaaaaaaggcttccaaataatcaggctgaatgggaagaaaaaggcatagaggaagcctgaggaagtatttacttgcttttcccatctctttataattggaagagaagatgatctgccaaaatataacccagcatgcacagtatggacaggaagcagccctccatgaactttattatcacagaatatgagcattcttattgatccacagctacatcttctattcttgcagcaagggtacatgtcctttgaccctccacaaaagaacaagcaggacatctctattttcctattgagtctgagtccattattagaaaggacttcccagccatcttttctacttggtattaaaattcccttacagattcattgctaagtgccaattctttttttttcttttgagacggagtcttgctctgtcgcccaggctggagtgcagtggcgcaatctcggctcactgcaagctccgcttctcgggttcacgccattctcctgcctcagcctcccgagtagctgggactacagacgcccgccaccgcgcccagctaattttttttgtacttttagtagagacggggtttcaccgtggtctcgatctcctgacctcgtgatccgcccgcctcggcctcccaaagtgccaattctgactctacttaaacatcacctgtatcagggagctcattattccttgaggtcttacatttctttcagcacattttgttccaagctacacgactttaaaacagagccagcctttggggcatatgttctctttggtgccacacaaaacctgtagtacatgatacagtgttgcttcccccctccttttccttccatatatatttgttttgttttgggcattgcattacttttttgaatttttaagaatctctaaaattagtctgaaggatgttctgagggccagacattagaatttgtgagtttttttgttgctggttgtactttcctatttagaagacagaccgttctgacagttgttgtgtagcttcatgccttccccagtaactaacccatgaacagtacaccccttttatctgacttgttgataatgaccttaaaaatgttaggaaatgggccgggcgcggtggctcgtgcctgtaatccagcactttgggaggccgaggcgagcggatcatgaggtcaagagatcgagaccatcctggtcaacatggtgaaaccccgactctactaaaaaaaatacaaaaattagccgggcgtgttggcgggcgcctgtagtcccaactacttgggaggctgaggcaggagaatcacctgaacccaggaggcagaggttgcagtgagcagagattgcgccactgcactccagcctgggcgacagaacgagactccgtctcaaaaaaaaaaaaaaaaaaaaaaggttgggaaatattggtgtataatccccatgtctaacaaggaagaagtcaaaagcaaaagatagtggtattgccgaaaactcattatttctagttagttcatctgtggaaaaggatatcgttcttgaggagaggggttctattatgctatagttttctatggaaatgtacaaatgctttcctcattgctctggatgactatttagtttaaataatatacctttgtcatggggaagaccatgattgtggcttcttctaccccaactttgaatgagagagcactgtaagcagaaactgccatcagtctcctgggcaggacctggaggtaactttctgagctgtaaaatagtaattcctaagagagcttacaaactgcttccacacagaaaatagcgcagggaggacagttattagtacccctattctagaagagaaagctgaggctcaagccattaagtgacttgccaaaagctgtgacatagctgggaagtggcagatttggggatataaccaggtcttgcaagtccagtgctgtctccaaagtagccacgctcacagctgagaacaccttagaggacaatatcgacttcttacagactaccaagcccccagtcatccagggaaattcagagaccaattgactgccaggtggcaaatccacatgtgtactgcggtctttagagatcatttagagcttgcacacatctgtgtcttcttgtgggaaacctctaggtattctgtctgatcagcactgtgaggaagttggtgggaaaaggccactgataagaacaaacaatgggcagaaggaagcacattgcaataaatttccccagagagagttcctttacattccattcaccaaaaacctctctggaactgtcaggttcagaatatcaaccaagaccatatcatttagaattcattggcatgtagaggtgactcgattcctaaaagaagcctctctcccatgaaccacgatgtacgttccacagaggcagaaaccgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacgtaacagttcagcaagcaagtgttccttctcttgagctgcgtccctcaggaagctgtacctttagggtgtgctttccactttttatttcctctcatttcactcctttcattgtttgctatatcctaaaatatgtgaagtgagagaaaaaatatcatttcttctcattaaatctcctgcattaaatctaagaatcctttaaaataatcacacctgataagtgttttatgcatttccctccctggagtgttatcatccatcaagccagtatcatcatccacctgcttattccttgggactaatgagagccaagttaaatagcaaatgacttctcaccccttcctagtcctcatgcctgaggaataagggcgacattaatgggagcgggagagtggtggctttggttgagatgcacgttcacagactagaaaagtgcctcacctccatggtgtatatgtgccaccttttcttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatctccacactgacttccacaatggttgaactagttcacagtcccaccaacagtgtaaaagtgttcttatttctccacatcctctccagcacctgttgtttcctgactttttaatgattgccattctaactggtgtgagatggtatctcatagtggttttgatttgcatttctctgatggccagtgatggtgagcattttttcatgtgtttcttggctgcataaatgtcttcttttgagaagtgtctgttcaatactatgcagccataaaaaatgatgagttcatgtcctttgtagggacatggatgaaattggaaatcatcattctcagtaaactatctcaaggacaaaaaaccaaacaccacatgttctcactcacaggtgggaattgaacaatgagaacacatggacacaggaaggggaacatcacactctggggactgttgtggggtggagggaggagggagggatagcattaggagatatacctaatgctaaatgacgagttaatgggtgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttaaagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttagggaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 16279 - DNA, 502 bp, Homo sapiens
actttttgtctgtgggttcgttcccgggtcccgcgcgagctttcccgggataagtagctttagcgatcgggagacagccgggcgctgcaaggtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacct

SEQ ID NO: 16280 - DNA, 612 bp, Homo sapiens
ggggaggaaggagggggaaaggcaccaaccagcagccgctccagccctgccgaagtttcactttttgtctgtgggttcgttcccgggtcccgcgcgagctttcccgggataagtagctttagcgatcgggagacagccgggcgctgcaagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctct

SEQ ID NO: 16281 - DNA, 535 bp, Homo sapiens
cccaccctgcccccacccttcccccttcattcctctgtcccttgttctggaagctgaggcgagaatgtctcagttctgttcccttcaggcttcgagaccaccgccttgctgtgtcccgtagtggactgagggcctgcaagagggagtgagggctagtggagggccagctgcctgtgggggctggacatcgtattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgagga

SEQ ID NO: 16282 - DNA, 386 bp, Homo sapiens
aggaattgaagagaatcctgacaagtggcatgttgggaaaggcctgaaggaagccagaccagcttgctctcagagctccttgggtcccctgcggcccccaggtgatcttcagcaagacctgcattgcagttggctgaaccttgtgtcaaccatccattccaggagccagctatctgagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgatt

SEQ ID NO: 16283 - DNA, 521 bp, Homo sapiens
gaggaaggagggggaaaggcaccaaccagcagccgctccagccctgccgaagtttcactttttgtctgtgggttcgttcccgggtcccgcgcgagctttcccgggataagtagctttagcgatcgggagacagccgggcgctgcaaggtgggaactttgaggctcagagacagagcagaagacagaacctggtcttctgattccctgtgttctgcttttttcattgttccactggacgctcatcagagggaagatctttttcctcaattgggacatggatgaacctggaaaccatcattctcagcaaactatcgcaaggacagaaaaccaaagaccgcatgttcttactcacagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacc

SEQ ID NO: 16284 - DNA, 400 bp, Homo sapiens
aatgtctcagttctgttcccttcaggcttcgagaccaccgccttgctgtgtcccgtagtggactgagggcctgcaagagggagtgagggctagtggagggccagctgcctgtgggggctggacatcgtgtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgcccc

SEQ ID NO: 16285 - DNA, 5835 bp, Homo sapiens
atttctcttccgagagcttcagtttcctcacgtgccaagcggacgggttggaagttggtctttgccagctctgacaccttcattgcagttggctgaaccttgtgtcaaccatccattccaggagccagctatctgagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggtgagtggggcctagagctgacttctgaagtaactatcttgctctgatttccttccttagtaattggaactattatcagctccactggtaaagtatttgagtccagatgcatgagagttgatatacatccccgcacaactaagtaattgtaggatttgcatttgcaagactgccatagatgtgatgtctacttagcttatactaaaatttcagtggtccttagagtttccttagatacaaattttattgttgagacttattttttaccagtctaggcaacatggggagaccctgtctccattaaaaatacaaaaattagctgagtgtggtggcatgtgcctgcagtcccagctactcagaaggctgaggctggagaatcacctgagcctgggaggtcgaggctgcagtgagctgtggctcagtgagctgtggttgtgccactgcactccagcctggacaacagagtgagaccctgtttttttgttttttgtttttgtttttgttttttgttttaaaaaagaagacattttttgacaacttattagcttcccattaggcagaaataggatttctgtgtatgttcccatttctcactggtctaaagattcaagtaaaaaatgtggaattggatattgtctgatatccaatttccagattgtactcttaatttttttttctatctcagttgaagaaatgatgttttctttgtagttttaattttcccctcttcaaacttgttaataactaggaatggttaatccttccaatccatgaatataatgcaaatttatgaattatatgccgattgtgaggttctgtggacgcataacctgtcctcagtgaggttaaaattgttcagaaagaggtaagacaagcatacaaataattactagtctaggtagaaagtgataaaagacatgagaaggcttaggtcaattgttgcaaattttatttttattttattttattttatttatttttgagacagagccttgctctgtcacccaggctagagtatactggcgtgatcttggctcactgcaacctccacctccggattttgagcaattctcctgcctcagcctcccgagtagctgggattacaggtgcccaccgccacacctggctagtttttgtatttttagtagagacgaggtttcgccatgttggccaggctggtcttgaactcctgacctcaggtgatccacccgcctcagcctcccaaagtgctgggattacaggtgtgagccactgcgcccggccagaagttttaaaagctccatttattaggagcatccggaatactttggtaaagaattggtggcacttgaatctgagccctttaaaccagtgcctttcacattttctgtggtagaagaccattttcctcccaatctgttggagaccagtatttttgttgagtcagttaaaattaattactagggaaataaaagacacaaaataaaatggaagatgaaattttatcattattagagttaactgttaacgaattactcttttaaatttttatactagtttctaaatattaatcctttgttcctgtatttatctcatccagggtgataagcatttcttagacacccatccatggaccactttttgagtggcactgctttaaggacaaatagagaaacgacatttggggaacagtattagtaaaggcacaaagatggggaaattgcacaggatttttgcttcttcaaatattttctattttcatgtcttttttgctcctatatgggaatatgtaatgacaggtcaactgaccacaccagtccaaaaacacacagtagatgaagtaggaggtattaggatatgaaaaccctggcttttatttgtgttggggtggcagtttagcttagctaaaagagcaaaaagagtgggaatgaaacatctggttgtggtctcttctctgtccctcgctggccaagcaatactggcatgtcacccatctgcctgagccccatttcccacctcactatatcaacggttggggcaaatgttctctagcatttctttcaacagtaataagttcaatgtacaaacatccttaatctaaagtataacaataaagctaaacataaattgatggagattaacaacaatgcatggagaacagtaaaacaaaacatagaaaatccacgaaggtttctagttacatcaaaatacacaaaaagtttattaatgctcttgtcattgccatgtgaggagggtttataatggggtctaaaatacattttttaaaagtgaaaaataaggtctctgtatttaggtcctattaaaaaggaaaagctgacttaccaagtatatatgcttcaaatatcatagcaacaaaatatattgccacaaaaaaaaaactgaacatagatgctaattgcatgaatgaatatatattgaacactctgggaaacagatataaattattacctttcccttcaagaactgtccaagctctactacttagtagcttagaaaacttgaacaagtattattccctctaaaccttcatttttgttttgttttatctgtaatatgggaataataactagcttatactgttgttttaagaaatggatgaaatatttatacaaagcacttagccaagttcttggcatgtagaatatgctcaatacaatactcaaggttctcccatgctcttggggcttatagtttatttaagacataagatatgctcgttaaaaatccattaataatgctcaatttaagtttaagttcctagcaacaatagaacgtatgtcactggtaagtaatcattgccaaatggggatgaataaccatttgagaatttggaaaaatggctaacttttattgagtgcttatgatatggcagcactatattttatttacattataggaattaactcatttcactcttataggaaaacataaccctgtgaaatagatactattatcattttcagattttgaaattaaggcacagaaatattaatttgcctaatgtcaacagctaatacattgcagaactgaattagaatgcagatctgtacatttacacaccacactgtaaaagatggggaaagctagccaggctacatatttagaagagtgtttatggtggagattagctttggacagatgggaaataagagatgagcattctcttctaggtacacagaattaacaaaatataagttgaggccaggattatttaaagaaaatttacgttatgtagaaaacaaaaaaaaaagtgcctatggtaatattcaggctgctctgctaggtggtggtgggggtagatgtgggtcttacctttgaagttcttatagtctaataggatatgtgtacagagttatggtgttataagcacaaggcagaaagtgacaagtgacttaatcaatgttcaccaagtgttctttgagaattcagaaaaaggaaagagaaaatcaagagagagaaatggaaaagtatttatggaatacttagcctttgagtaagtctttaaaattgtgctaattgagatttggaagtaggaagatagtagagaagtgaagtcatttctcatgaggggagtttttgacataacagggaataaaaccactggagtgaagtgtccacgtgagaagtagcaaatattgggaaataaggttcaagtagtaggttaggaccaatctagggaaggctgtcaatgtccggctaaaggctaagaacgttattgtctataatgagcccttgcacattgagatcacatgccatgagaactgctctgtggatagtggttaaaaacatgcactccagagccaggatgcacttcttaccagcaagatgaaatcaagaggcaaaggactagtgaaaagaactgtcctttattgttccgtgctttaaacatttctcaagcaccttctctgtgcctgctactgtgctgggtgttcaggacacccaaatgcagaggctctgccctcatggggctcacgggttcctaggaaggacaagagagtcacagatgtcaaggattttagtgcagatattagcactgtgttgggtgtgactgagctgctatgtgagagtccataagtctgcctgaggatgagcggaaagaatacatagcagtgtgtttgcatcagcagggcctgacccaagagcgataaagtcttctcttcctttctgtcagagttttacctttggcctattctggactgcaaatagcattgccaagcacttcccttaaataacttctcttttttgcaggactatcctctcagccctgccaaaaccccatcacctactctttctttactactttgcctatttaatgctggaatttttatttaaactgtagctgatttactgaaggtaattaagtgctttcatgctgtagatctcctgctagactacaggctgtacttgggagtgagagtgaacaaaatgtaaataaatgatgtcaacaga

SEQ ID NO: 16286 - DNA, 343 bp, Homo sapiens
gtgggttcgttcccgggtcccgcgcgagctttcccgggataagtagctttagcgatcgggagacagccgggcgctgcaagcattgcagttggctgaaccttgtgtcaaccatccattccaggagccagctatctgagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtga

SEQ ID NO: 16287 - DNA, 479 bp, Homo sapiens
gatgggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaaccca

SEQ ID NO: 16288 - DNA, 18221 bp, Homo sapiens
gtgggaactttgaggctcagagacagagcagaagacagaacctggtcttctgattccctgtgttctgcttttttcattgttccactggacgctcatcagagggaagatctttttcctcaattgcattgcagttggctgaaccttgtgtcaaccatccattccaggagccagctatctgagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctagttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataactattgtattttcagaattttaacacagattaacacttagcctgtaagactaataatatattgtaatagttgatactaaaatatttttcagcaggttggacagcaccagtttttcttagatcacagactacaggcagaatttcccttcaatccagaaaaaaggacactaatttccttttctatttaattttcctggcccttgtgcaaaaaattgtggactctatcttagttacaacatgcatgtcccttattttgtggagagctgtgtgaaagatgcgttttttttctttttttcttttttttttttttgagacggagtctggctctgtcacccaggctggagtgcaatggcacgatctcctctcactgcaagctccgcctcccaggttcacgccattctcctgtctcagcctcccgagtagctgggactacaggcgcctgccaccacgcccggctaatttttttgtatttttagtagagatggagtttcacagtgttagccaggatggcctcgatctcctgacctcgtgatccacccgcctcggcctcccaaagtgctgggattacaggcgtgagccaccgtgccccgcgtgtttttttctttagctgattgacaggtccccttcaaagttacaaaaaaaagtgctaatttttgctgttaaattctggttgttatttaattgacagaagtctcttgatgcacgaataaatatctctacatctagcctttgttaaaaataaaaattaatattctacaaacacctacatatactagagaggggtgaaacactgcagctaattcctttataatactttcagatgattgcattaagcctttcatgttatgtggcattgttaatttttcctagatacccatccacttaagggccagagaaatccttattcatttaactctggtgggcatttatgtaacatacccaaataaaaacgttattaaacagccacaatcgcattcagtcaacttggcactgaatgtagcttctaaaatcagttctctaccctacgaatggaatgttctaccaagaaagagaagcatcaccatgtcatcttgtgttctacaccactatagagagttacagttgcccccaaacacgaatgctattcccaaataaaatagaatcatgctttgggaggccaaggcgggccgatcacgaggtcaggagatcgagaccatcctggctaacacggtgaaaccccgtctctactaaaaaaaaaaaaaaatacaaaaaattagcctggctcagtggcgggcgcctgtagtcccagctactcaggaggctgaggcaggagaatggcgtgaacccgggaagcggagctttcagtgagccgagatagcgccactgcagtccggcctgggcgaaagagcgagactccgtctcaaaaaaaaaaaaaaaaaaataggatcatggcccttttaaagatctgaatcttctctgttattttcctgatgaatcaccatcccatatcttcttagtcctggccagtatgtagttgcgctcacatacgtctattctagctctgtagctccacaaaacaagtcttaagtccaaatctttgcctcttcatgtctgatatcaccaactcattcagcttttcttcacttattgacatagtgtcatgtcctatcactctctgctgcttctttaaacagtggacacaaacatattttctaattttcagtgtactcagtgaaacttggcagttcaccatgagtcaggctaggttgaaaggctttctttagggttgaaagtaaacgaaattggaatcacccaaagagaatttccccaaaaaacctcagacccagaagtgtaaaagctacagaaggatagaactcccatgtctacagacagttctgttactttttgttctgtactattttggatgttgccaaaatcaaattcatcctgaaaacaggaagcaagctaatgcatatgccatccatgagattcccacttctgggtcagttcatattccattcaaccttttccttttatccttgtcttcttcagaataagacatttttcctccatattttcatattaaatattaacactttataggttctactttaatatatggacactttacaggttatacataaatatttgctggttgattgatttcgagattcattcattctgtgctcaaatatttgtacctagagacgttacatgttagaaaaagtgagcagcttctttctctaatcatttaggagtccatatttttcttttctttttgttctcccaacatccttatctcttactcagctcttcaatttataattaccaaataatcactgttagagaatcagcccctaagtaactttgattctggccaactgtaataagatccaaccacttaaatctgtacttactcaataggaaggaatgtgacatcaggaagagtcattccagtgacattagtaagactttatggagtacataaaatttgataagaaatcttgagctgattctttgacttgatttagaagttgagaaaagagtatttaaggcacaacagggaaacatgggctatactcagagaagaccctctgcattggccaaaatatcatggattctggaaattccttcttaacagaaaaaaaaggcttccaaataatcaggctgaatgggaagaaaaaggcatagaggaagcctgaggaagtatttacttgcttttcccatctctttataattggaagagaagatgatctgccaaaatataacccagcatgcacagtatggacaggaagcagccctccatgaactttattatcacagaatatgagcattcttattgatccacagctacatcttctattcttgcagcaagggtacatgtcctttgaccctccacaaaagaacaagcaggacatctctattttcctattgagtctgagtccattattagaaaggacttcccagccatcttttctacttggtattaaaattcccttacagattcattgctaagtgccaattctttttttttcttttgagacggagtcttgctctgtcgcccaggctggagtgcagtggcgcaatctcggctcactgcaagctccgcttctcgggttcacgccattctcctgcctcagcctcccgagtagctgggactacagacgcccgccaccgcgcccagctaattttttttgtacttttagtagagacggggtttcaccgtggtctcgatctcctgacctcgtgatccgcccgcctcggcctcccaaagtgccaattctgactctacttaaacatcacctgtatcagggagctcattattccttgaggtcttacatttctttcagcacattttgttccaagctacacgactttaaaacagagccagcctttggggcatatgttctctttggtgccacacaaaacctgtagtacatgatacagtgttgcttcccccctccttttccttccatatatatttgttttgttttgggcattgcattacttttttgaatttttaagaatctctaaaattagtctgaaggatgttctgagggccagacattagaatttgtgagtttttttgttgctggttgtactttcctatttagaagacagaccgttctgacagttgttgtgtagcttcatgccttccccagtaactaacccatgaacagtacaccccttttatctgacttgttgataatgaccttaaaaatgttaggaaatgggccgggcgcggtggctcgtgcctgtaatccagcactttgggaggccgaggcgagcggatcatgaggtcaagagatcgagaccatcctggtcaacatggtgaaaccccgactctactaaaaaaaatacaaaaattagccgggcgtgttggcgggcgcctgtagtcccaactacttgggaggctgaggcaggagaatcacctgaacccaggaggcagaggttgcagtgagcagagattgcgccactgcactccagcctgggcgacagaacgagactccgtctcaaaaaaaaaaaaaaaaaaaaaaggttgggaaatattggtgtataatccccatgtctaacaaggaagaagtcaaaagcaaaagatagtggtattgccgaaaactcattatttctagttagttcatctgtggaaaaggatatcgttcttgaggagaggggttctattatgctatagttttctatggaaatgtacaaatgctttcctcattgctctggatgactatttagtttaaataatatacctttgtcatggggaagaccatgattgtggcttcttctaccccaactttgaatgagagagcactgtaagcagaaactgccatcagtctcctgggcaggacctggaggtaactttctgagctgtaaaatagtaattcctaagagagcttacaaactgcttccacacagaaaatagcgcagggaggacagttattagtacccctattctagaagagaaagctgaggctcaagccattaagtgacttgccaaaagctgtgacatagctgggaagtggcagatttggggatataaccaggtcttgcaagtccagtgctgtctccaaagtagccacgctcacagctgagaacaccttagaggacaatatcgacttcttacagactaccaagcccccagtcatccagggaaattcagagaccaattgactgccaggtggcaaatccacatgtgtactgcggtctttagagatcatttagagcttgcacacatctgtgtcttcttgtgggaaacctctaggtattctgtctgatcagcactgtgaggaagttggtgggaaaaggccactgataagaacaaacaatgggcagaaggaagcacattgcaataaatttccccagagagagttcctttacattccattcaccaaaaacctctctggaactgtcaggttcagaatatcaaccaagaccatatcatttagaattcattggcatgtagaggtgactcgattcctaaaagaagcctctctcccatgaaccacgatgtacgttccacagaggcagaaaccgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacgtaacagttcagcaagcaagtgttccttctcttgagctgcgtccctcaggaagctgtacctttagggtgtgctttccactttttatttcctctcatttcactcctttcattgtttgctatatcctaaaatatgtgaagtgagagaaaaaatatcatttcttctcattaaatctcctgcattaaatctaagaatcctttaaaataatcacacctgataagtgttttatgcatttccctccctggagtgttatcatccatcaagccagtatcatcatccacctgcttattccttgggactaatgagagccaagttaaatagcaaatgacttctcaccccttcctagtcctcatgcctgaggaataagggcgacattaatgggagcgggagagtggtggctttggttgagatgcacgttcacagactagaaaagtgcctcacctccatggtgtatatgtgccaccttttcttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatctccacactgacttccacaatggttgaactagttcacagtcccaccaacagtgtaaaagtgttcttatttctccacatcctctccagcacctgttgtttcctgactttttaatgattgccattctaactggtgtgagatggtatctcatagtggttttgatttgcatttctctgatggccagtgatggtgagcattttttcatgtgtttcttggctgcataaatgtcttcttttgagaagtgtctgttcaatactatgcagccataaaaaatgatgagttcatgtcctttgtagggacatggatgaaattggaaatcatcattctcagtaaactatctcaaggacaaaaaaccaaacaccacatgttctcactcacaggtgggaattgaacaatgagaacacatggacacaggaaggggaacatcacactctggggactgttgtggggtggagggaggagggagggatagcattaggagatatacctaatgctaaatgacgagttaatgggtgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttaaagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttagggaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 16289 - DNA, 3526 bp, Homo sapiens
attcgccatcattttgcacactgcgaggggctccgtgtgtgcgccctgtcttgtctggccgtcctcatcccttcccccaccccctgccgccactccgacccgctcccaaagtggcttcacaatagtcggtcctcggcggtgtaggctgcgcaccaggtccacacttaagcgaaatcaaggagacccccttctacttctacctttgggtttggtgctcaatgcgaagctgctgcaactcagacacgcctaagtcaactcatgcagaaaaaggagaaaagttttggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttc

SEQ ID NO: 16290 - DNA, 3759 bp, Homo sapiens
atatcctaatagattgagattcaaactgatgcagcacattttttacggggactactcagattgctgttatgaaatacaagtcagatttatgatctttttcatattgaacatgatatgctatgctaacgctgcatgtgacagtttaatcaaatccatttgttaccaggaagctaaaaggggccgctgggattttaggattacgggcagagttagggaagcatgtggctttgtcattcgccatcattttgcacactgcgaggggctccgtgtgtgcgccctgtcttgtctggccgtcctcatcccttcccccaccccctgccgccactccgacccgctcccaaagtggcttcacaatagtcggtcctcggcggtgtaggctgcgcaccaggtccacacttaagcgaaatcaaggagacccccttctacttctacctttgggtttggtgctcaatgcgaagctgctgcaactcagacacgcctaagtcaactcatgcagaaaaaggagaaaagttttggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttca

SEQ ID NO: 16291 - DNA, 3450 bp, Homo sapiens
gtagaacagtggggagctgtgcggatgggtgaagtgcatgtatgcctgcctagacgggccagaaaagccaaacttaagaaatctgcctatgtacagaacaagtcaactaaggggttctcattaatctaccgtctgtgaatatcgttatttttcaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattcacttttttacatttggatttatgtttttaataaaaggggtgttacact

SEQ ID NO: 16292 - DNA, 3515 bp, Homo sapiens
acacatactggggtgttttcagagtggctgtagcagagaggtggggtagaacagtggggagctgtgcggatgggtgaagtgcatgtatgcctgcctagacgggccagaaaagccaaacttaagaaatctgcctatgtacagaacaagtcaactaaggggttctcattaatctaccgtctgtgaatatcgttatttttcaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattca

SEQ ID NO: 16293 - DNA, 3365 bp, Homo sapiens
gtcgactcctgcagaggtcacattttgtgtgcgggtttgtccccagcgtttgagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattc

SEQ ID NO: 16294 - DNA, 1016 bp, Homo sapiens
tctgggacgccacagaaatcgtaactgaacacccgcacacaaaagtaatctgtgaggtgtgttttaaagaaagaaacagctgaaaacttgaagacgtgtttagaaatatacatatatacacactattttcttgtgggagatctcctttgggcaaaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccat

SEQ ID NO: 16295 - DNA, 1488 bp, Homo sapiens
ttccccaacctctgctaatgaggcataaactggagctgcaacccagctccgcactgcaactttcactcgggctgcagctctactgagacggttttgtttaaatcatgtgaggcttcattatttttatgatgagacatgaaatagatgcaggcggaagatgttgatggaaggagggagagcggctgcggcgcggaacgtctcaagtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtg

SEQ ID NO: 16296 - DNA, 1685 bp, Homo sapiens
cgagaggtaaatagtcttaaatcggaagggagctgcttctctgtggtcttgacaagcgctgcctgggctccgccggctcactaataactgagtgaccttttctttggctgtattatgtctggctgggaagggattgcattttgcagctgagagccggagcttccttcagctcggctcctcgcacgctgctggggtaagttgtcttgaaccaggacggagagagacagcctcggactgcagttgcctaaaaggaggacacctgtggctcagatgcggtcaacaccattgcttggcgtatccttgaggacctcattattttaaacttaaaaaaaaatagacattccctcccccgtcttttttttttttttcaaacaatgcttctttttgacctttcccaaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttg

SEQ ID NO: 16297 - DNA, 516 bp, Homo sapiens
aatggtgcagaaactatggttctttgaccaagttagtcctgaaaacatgtttctcagtgctgttggctgtttttcattggagcgtgagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaattttt

SEQ ID NO: 16298 - DNA, 622 bp, Homo sapiens
atcataagatatcagaggaaactggaggaggtttagctgttttggagaaggaaaatgtacaaaagtgcagattatagcttgacatttcttatcctataatgcatgcacatttggtgttttgtatccttctacatgcaagtttaaaactttatgcctaggagagcaaacataatgcagcagaagggtctctggactgtaagaaggccatttggctggagtctatagcgtaactgtctttcagctttgagcaagtctctgaacctctcttgggcctcggtaacataatttgtaaaatgagggaatttggaattgatgatgtctgcagtactttatagtgcttaaaatgagttatttgataaatatgaggcattggatagttggtccagcttcttgctaaagctgggtgttttaatacctaggaaataagaagacactcaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagcta

SEQ ID NO: 16299 - DNA, 579 bp, Homo sapiens
ttcttctcagtgcattggctgagacagagcgcacgagacacacacacatgcatgcacacatatgcacacacacacactcacacatactggggtgttttcagagtggctgtagcagagaggtggggtagaacagtggggagctgtgcggatgggtgaagtgcatgtatgcctgcctagacgggccagaaaagccaaacttaagaaatctgcctatgtacagaacaagtcaactaaggggttctcattaatctaccgtctgtgaatatcgttatttttcaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgttt

SEQ ID NO: 16300 - DNA, 543 bp, Homo sapiens
aatgcatgcacatttggtgttttgtatccttctacatgcaagtttaaaactttatgcctaggagagcaaacataatgcagcagaagggtctctggactgtaagaaggccatttggctggagtctatagcgtaactgtctttcagctttgagcaagtctctgaacctctcttgggcctcggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaattttt

SEQ ID NO: 16301 - DNA, 565 bp, Homo sapiens
agtatcaacctcatccttcccttgaccgagacctttcactgctcctggactttcagggtgtgctatcctttgcctccccccaacaacctgtctgctgccctaaaaaaaaaattaaaaaaaaaaaagacggcaacctaaccggagcatctctgggacgccacagaaatcgtaactgaacacccgcacacaaaagtaatctgtgaggtgtgttttaaagaaagaaacagctgaaaacttgaagacgtgtttagaaatatacatatatacacactattttcttgtgggagatctcctttgggcaaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatcc

SEQ ID NO: 16302 - DNA, 1574 bp, Homo sapiens
agatctaactgtcaatacagtgagtagagtggagtccggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagattt

SEQ ID NO: 16303 - DNA, 983 bp, Homo sapiens
actcgggctgcagctctactgagacggttttgtttaaatcatgtgaggcttcattatttttatgatgagacatgaaatagatgcaggcggaagatgttgatggaaggagggagagcggctgcggcgcggaacgtctcaagtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgttt

SEQ ID NO: 16304 - DNA, 573 bp, Homo sapiens
gagaaaacacagctctgtcaatggactgaatgcaccattaaaactggcgtcactacaaaggttagagcagatctaactgtcaatacagtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacat

SEQ ID NO: 16305 - DNA, 1762 bp, Homo sapiens
atgtacagaacaagtcaactaaggggttctcattaatctaccgtctgtgaatatcgttatttttcaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgctgggagaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttga

SEQ ID NO: 16306 - DNA, 530 bp, Homo sapiens
atcatagatgcactttgctggcgctctgcactcctggccgctcaaaagcctttctgcttttccgctgcttttgtgtctttctgaaagaaccgaaatattattgttgtaactgctttgaaagactgctgcttaaaccaattaatcttgctagatgcaacaaatactgctacattctttgcaaaccatccctgtgtggctgcaaagacacaaccacaaaaggctggagcataaactccgcaagggattctttgttagagtgtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgag

SEQ ID NO: 16307 - DNA, 590 bp, Homo sapiens
ctctccttctctctctctctctcctccttgcttggcagtattacttgcttataagtgtgggggaaatggtaaaattgagaggaaaaggaagattggggaaaaaggaagaggatgggatgcacttagagatctgggtgtttgtcccttaagaaaaaggtgacaaagtggttaatgtctttgcaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagag

SEQ ID NO: 16308 - DNA, 496 bp, Homo sapiens
agtcctgaaaacatgtttctcagtgctgttggctgtttttcattggagcgtgtgagttttaaatagagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaattttt

SEQ ID NO: 16309 - DNA, 1260 bp, Homo sapiens
ggggctgggaggaggtgccgcgaggggtggagcgcgcagcggagcctgctctcggagttttgacagtaccggagctgaaattgtcagcggcggcaagcgcaggaaagttgagaggagctcgtggccccagaacaaagcttgagaaaaaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaa

SEQ ID NO: 16310 - DNA, 3587 bp, Homo sapiens
gctctgtcagtaacacatgtgtaagagccgcggagggagcgagcgagccggctagaggccagcgccgccgccgccgccgcctccgagccgggcagcaacagccccggcagcggcgcaggctccagcgcgccgggcccggccggccgcagcccccgacgcctgggtgcgcctgcctgccggcctccgcaccgtccgccgccgctcccggggctgttgtgtctgcgactgctcccggccggaggtgcagggagctcagccgagccgccgctgccatcccggagcgagcaagcgagcgagcgcgcgggagggaggaaggcggcggcggaggaggaggaggagcgggaggagcgcgggcgggggcgggggcccccgggcgggggaatatacaaagtgaagccacattgccaaacttgcagcagcgattgcagcagttgctgccgctgcgccgcgcctgaagccgcgccgcgcgggccgagggctcctgcagctgctcgcgcgcagtcggaggcggagaaggacgaagactgagactgacacttctgctcccggccgcccggcacttacgcgggggccccccaacccgccccagagcaacgcgatttaaaaaaaaaaaaaaagccgcccttagccccctcctcccctttcctgcttctgcgagaactccctccctccctccagctccgccagcccaggcgccccttccctggaagccgagcggcttcgctcgcatttcaccgccgccgcctctcgcaatattgcaatataggggaaaagcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaatatttaatggtgtttgggtttaaacactgctttttctcttctgtattttgaagaaatttagtttttattgttgttgaataacaagctcactttaaatttgaaggagttgagggaggtggagtgtatatttatttagctctgggccagtaaggtattcttcaaattacttaaccacgccattattggcaggggtacaaagtagtttctaacagggtcctttctataagtcaagaatattctgttaacagcatttcgttacacttctatatcacagtaagtcttttgtgtttataaatacttgagtgtccactattttgtttattctttttctcaatagcaaacaaagccttgggtattgatgaaaagtatgtataaaaaaaaatacggcacaaccatcctgttctcttattgagtttatagcttttgaaggaagtcacaatttctaagtcatacctgtacatattttgaagctcacttagttgtagggacccagagctctttttttatggtgatctttgattggtgaagtagccatttcctggtgacccttaggctcgtgtggttggctgtaaggtgtttattttgttttgctcctacacttctttactgactgcgtttccgtatgtattttgggggaagattctgacttcatttagtcttagtcttgagatactgagttgctggttgcaggcagcagagtgtccaccacagtgcctgcactgcccgcagagctgccctccggaaagcatgcagtataacagctagtgctggaaggaggaaaaccaaataggcctggaggctgaggttgtactgccagcttccttagatgtgagcaaatttcaactacaacttccatcacaggctaataaaaccaggtgtgtgaacgctactattttaaattttcttttttaagatggcattttattttgttccagaaaagcgcctgatgtagaccctccctctgagaatagccgtggagccatgtagagaggtgtagctcagcacatctcaactaccagtcagcttccctttgagaacttctgtgctcacttcctgttttcagagattccagggcaggggaaaaaaaaaatcagttgaacttcaaacctcctagaggagattgtaaaggcatagagttgaggtgaatagttttgttagaaccttataaaaataaaatgcaagaaaataatatgaagaaatcacatatatatgtttgaattagatgtctgtttgaattagatccttggggaatttcttcaaactagttctggttcttatatttgttttttttcctttaaggaactttctgaaggaagttagactgcgatggtaaagggggaaatgggttaatgagattgcaggcattttctatattctttttggcataagcacttatgtccctgatatgtacaaattcaaaggaggtggttaataactttagtaaataatatattgtcgcatttaatgatgtggagggctaaggtcattacggactttaaataaactattatatggctggttcctcaa

SEQ ID NO: 16311 - DNA, 11331 bp, Homo sapiens
gcccggacacctgtctgcagcatggataagtatgacgacctgggcctggaggccagtaaattcatcgaggacctgaacatgtatgaggcctctaaggatgggctcttccgagtggacaagggtgcaggcaacaaccccgagtttgaggaaactcgcagggtgttcgccaccaagatggccaaaatccacctccagcagcagcagcagcagctcctgcaggaggagactctgcccagggggagtagaggccctgtcaatggagggggccgcctgggcccacaggcccgttgggaagttgtgggcagcaagctgactgtggatggtgctgccaagcctcctcttgctgcctcgacaggggcacctggggcagtcaccaccctcgctgctgggcagcccccgtacccaccgcaggagcagagatccaggccatacctgcatggcacgaggcatggcagccaggactgtggttccagggagagcctggcgacttctgagatgtctgctttccaccagccaggcccctgtgaggatccttcctgcctcactcatggagactattatgacaacctctccttggcaagcccaaagtggggtgacaaaccaggagtgtcccccagcatcggcctgagtgtagggagtgggtggcctagctccccggggagtgacccaccactgcccaaaccctgcggggaccatcccctaaatcaccgacagctctccctgagctccagcaggtcttctgagggtagcctcggtggtcagaatagtggcattggtggccgcagcagcgagaagccaacaggcctttggtccactgcctcctcccagcgggtgagccctggcctgccttccccaaacttggagaacggagcaccagctgtggggcctgttcagcccaggaccccttctgtgtcagcacccttggccctgagctgccccaggcaaggaggtcttccaagatcaaactcggggctggggggtgaggtttcaggtgtgatgtccaaacccaatgtggacccccaaccctggttccaggatgggcccaaatcttacctttccagttctgccccgtcatcctcgccagctggtctggacggttcacagcagggtgcggtccctgggctggggccgaagcctggctgcacagaccttggcactggtcccaagctcagccccaccagtcttgtccatccagtgatgtccaccctgcctgagttatcttgtaaagagggtcccctgggctggtcttctgatggtagcctgggatctgtgctcctggacagccccagctcccctagggtaaggctgccctgccagcccctcgtcccaggtcctgagctgagaccctctgctgctgagttgaaattagaagccctcacccaacgtctggagcgagagatggatgctcacccgaaggctgattactttggagcctgtgtgaaatgcagcaaaggggtgtttggggctggccaggcctgtcaggccatggggaacctctaccatgacacatgcttcacctgtgcagcttgcagccggaagctgagaggaaaagccttttattttgtcaacggcaaagtgttttgtgaagaagacttcctgtactctggtttccagcagtcggctgacaggtgttttctttgtggacatctgatcatggacatgatcctgcaagccctggggaagtcctaccaccccggctgtttccgctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgagggctcagatgagaccatccgtgtcgtgtccatggacagagactaccacgtggagtgttaccactgcgaggactgtggtctggagctcaatgatgaagatggccaccgctgttatccgctggaggaccacctgttctgtcactcctgccacgtgaagaggctggagaagagaccctcatctacagcccttcaccagcaccacttctagccagagccacttgcagacatcacggcaggggatgaggagccggggttgctgctgctgcttccggtggcccctggggtggaagtggggtaggggaagaggaggggcaggagggagagttcctgtgagcatgtggggggtgcctttcctttaaccagggaggtgaacactacctgcctcctgcgtgtattttccaagtgcttttctctgttgccacattttcctcaggttactcaggaaaatgctccagcatgtgcgagcacatgacctgaggttgcatcatagcaccaaaggaatcctcctgtcccctctgggaacatttcatgcttcagagggagaggtttttattgagcttgtttcacaatatccccttgaagggacagctcagctgccaatacattcaaccctttctcttccttcaggaaaatacctatacccaaatgttccctcccccgacatatatcatggcatgatttaaggcttcttttcacctgagagcttcagttcttctgcagaatggctgcaaatttaattgcattaaggcaagaaggaagctctaatgtgtgctttgtatcctaagataaatttgcttagaaaaccagagtcaagatttgaaataggtgaggcagggtttcctccttagacactgacagcattctctgtaccccttcaaatccttactctcctaaaggcagctgagtccgcgacagaaatttgccctatgtgagtaaaacatactttgggagaagaacttggtgcaggcaccaggatttttttttttgcccacgtgtttgcgctgtttttctctggagttctcaagagttggtgacttggaaggccgcttctgcaaggcaagtctcaggaacccatgcaggtacatcgcttgcacctgtttttagcttatttaatgacgggcttttgggaagagctgcccgcatactgagagacagcttcttataaacaaggagagtttttgtgtgtgcgagatctctaagccagcgtgggagggagcgcctcaggataagttattatattcatttcgttggtttctctcctgcccaattcttggcacaggcattatgtttgaagaaaccaggataaggtacactgcttttgtctgtttaatttttttagttgtttcccttcactttcagtcttccacacacaaaaaatacctcacagagcttcaccaaatcacagattcaggaggaatttggctttcacactggactcagataccttcttcagtgtgttggaaatcactggcttcacacaggcccaactccagctggtcagggcagagtgatcgtaactaaaggtcagtggggaatagatccgattcagtgcttttgccttatgcatttcagcatcctggctccccagggtggcaggagctgagggagggccacacactggcaagatttcaagaccactctctgcactgaagaggtaaaatttgcactgcaagtcacatccctgaggccagaggtcagtaccctttggtatttcgattagaagaagctgcaaaagaaaggcagcccattttaccattgccagccaggccggggacacaggagccggtgtgtgcactctgcctcctcaccttgcacccagagcaagaggactgggtgctgggctgcagaggccggtcagtggagcccctagcacgtgtgaactcaggcttttcattgggcccggctccacttctaggccatgttttgactcatttggtaaccattgcctgtaagcagcacagaattggtgccatggattatcttttccatgttgatggaattcattctgttggaatcctttggccagatgtcacttcagccagggtgtgcatcatcattggttctttttcacaggctgagcctcctgaaaacccatgaacgctggggctggggaagtgaaccctgaggtggggaccctctcttcccatcaaatcatccagctcagtgtggggcgtggcaggggggtaaatgaagccagccaatgtgttaacctgtctctgtcaacctaagaatgttggccttactgacacacctttgctccatgttcaagaccagaagtagctgggatttgtttgcaaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccaggaagaaaagattttaaaatttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcgtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttctgtcacacaaaatgaagaacagaaatgttaggacttaagagaatgtttggaattcacacctctttgcagtcctttcaaggctgctgctctgtgctgtgtcccatgcatgtgaaagtagagctgtgatggctgctgggacgcttgcaaagatcatgtgtgagaattgagcacaagaccacaaattattactgcttgatgcgcttgttaaaactctatctgccaggaaaccaaattttcttttcttttctttttttttttgagacagggcctcactctgttgcccaggctggagtgcagtggcgcgatctcagctcactgcagcctccacctactgggctcaagtgatcctcccacctcagcctcccgagtagccgggaccacaggcgtgtatgactggctacgcctggctaatttttgtatttttaatagagacgagtttcaccatgttgcccaggatggtctggaactcctgggctcaagtgatctgcccacttccgcctcccaaagtgttgggattatggccattagccactgtacctggcacaatttttttttgtaccctcctttatgccaagaatcagtcctaatttctttactatgtgaagtaacttttaaaggtaatagaaaaggccaggcacagtggctcatgcctgtaatcccaggcgccgtggctcacgcctgtaatcccagcactttgagaggctgaggcgggtggatcacttaaggtcaggagttagagaccagcctgaccaacatggtgaaacactgtctctactaaaaatacaaaattagctgggtttggtggcgcacgcctgtaatcccagctacctgagaggttgaggcaggagaatcgcttgaacctgggaggcagaggttgcagtgagccgagatggtgccattgcactccgacctgggcaacagagcgaaacactgtctcaaaaaaaaaaaaaaaagtaacagaaaaaagagtgaaatatattagctatcttttattctgagccaaaacttgacagatgtgggaaatcttcatatagtgtatgaaaatttcattgtacagggaaattattttcctctgtgtcttttcttttactataaagtgattcagaattttactgttactataaaattatgcaaagtattgtgacaaaactgcatcaatttgttgactattaaagtgctccttgaacattatatttcctgggtcttttctgtgtgtggagtcagcaaactgttttttgctacctggactttgtcttcttttacagctctggattcttaaaagtaccacataggtagcaaacctgtgaagggtatgagattttaccctacttgcaggctaataaagtgagcacaccacatgggttcatggatcctggcagaagttatgagactcataggtcagagacaaaggacagtttattatagcaatagcagtggccagattatcagcatttacactggttccctgagccccaggccccaagaagagggccaggtgagacctgcacacgcagtgggctgcattacaagaggaacccccatgcttaggggaccctggtatttgataatgggcagtaagcctgcctgacttttgctccagagacagacactatctctgtcatccaagactgttcactagataaacatccttgaaaatataagtctggaacctggcaattggtgtctattcttaccagatgtataaaaatgtgagaggccttggagaatcatatcccaagaatcagcagtttcttttactggacctttaagattgagacttgtaaggtcctgatgcagtgacttgtaaggtcactttgtctctcttgtgaatgttactgttttttctcttctgaggttatgaccaaagaatcctcaaggcgagtgatccttcaggtttgagacagccacatgcaggaagacaggacttgtagagtgttggggccaagtgtgtggttagaatccttggggtggggaaagagtttgttctagactccagtgtagtccttgtggctaccaggtctgacgtgccaaggacacgggaaagctgggagtgaggatactcatagtcatagcaccttacaccagaataaaagttttttttttctttttaagtgatgagagaatggctagtctgattttgccaacatgggctgctatttgcttaagaccttgatggtataaggagtgaagatgcaatcagggtaaaaggcggtctggagttgtggtgtgctggcaaaccagccctctggggcaaaaaattaaaaagccttgatatggagtgtttgctgatacctatgatgtaaatattcccgccatggccactttccagctaccagcaaggcatcctggcaccagggattgggaggagatggcatagtcctaagagtcagccttgggcattgggccatgtgggactgggcagtggggtatctggtctggttctaagtgctgtgatgaagcagtagcagctgtaatagctggcatttcccgtgtgctcatcacatagcagatgttattccaaggactgtatgttctttatcatccctcatttgatagacaagacaactgagacacaaaagggtgaaataaacagtaagtactccatcccaggccatctcatccagagggtgctgtcttgaccactctactactctggttgatgggaggcagtaaattgtccatcagtatacttcttcatcaaagctacatagtcaaaaagccacaggaggctgtgaggagaagctcactgctgctctgttgaagtctgtattggtttcctatggccactcttaacaaattaccacaacctcagtggcttaaaacaacacaaatatatcattctgtcatcctggacacgagccaaaggttgtcggcagaagcgaattgcttccagaggtgctatagggtgctgcccattccttgccccttttccgcttctagaggctgcccattttccttggcttgtggctgcatcattctggctgcttctattgtcacacctcctctctgaccctccctgcctccttgtaaggacacttgggattacgcccatccagataatctagaataatctcccattttgtgattcttaataacatctgcaaagcctcttttaccttgcagaataagatattcacaggttctggtgaggaggacagggacatctctgaaggggagggaagcaggagatagggtctggaggcatggaattggcttcctaaggccaattcaggctgacttcctagaactaagtcaaaaggaaaaccccaactttccacgctcaagtaacaaaaggaccagaggctactccctttgcaacctccccacccccagccccttttctgcatggcaggtgaaaaattgaaagtatcgctaattgatcccctcccacaaccaatcagactggtcttaggccaagtcttcatttgcctaggagtataactttgtaacttcagcctctgattgggcgttttacacaaccagtcagatgtttgtatagggtggtgtaactttgtaactttgcttcagcctctgattggtcccctcccacaaccaatcaaactgatcatggacctctgcttcatttacatagggtgtacaccaagtaaccaatgggaaacctctagagggtatttaaatcccagaaaattctgtaaccgggttcttgagctgcttgggctgctcccaccctgtggagcgtactttcgtttttcaataaatctcttttgttgcttcattctttacttgctttgtgcgttttgtccatttctttatcaagacgccaagaacctggacaccctccaccggtaacaggaggagcattagtcagcctaccacagactccaacgaacgttttttgagaggaaatgaaagaatattcctaagttattgggtgccttttcttcaggaatccctgaaagtgggggtttgcaattttccctggattgaaaacagaaatgcttcctacacaaacatgattgagaccttgtactctaggtgtaaaaaaacagagtaggtcatactctgtgggttatggtcagagagatctggttagaagttcccaggtaggcgacagccctagatgtgtgacacttctaggagaatctctggctatgtggatacgtccaggtgtgtaaggcagcctcagggactgccaccacttggtcacatacatgtccctccaactaatcctagctctcaaggacaggtggttctgggccctgtgttgcccatgagacttggtccacggcaagcctgtgacggagtgaaagtgaggggacacccaatttgaaaactcggcaggaagccagactccatgacatacaaatagatcaaagtgaatcggctccgttgtttggggaaatacctgaggtttgttgtttcgtgccaagaagattaacaacacggacacacgtgggtgggttaaggagcagaaagtttaacaggcagaaaaaagagaacagctcccccatgcagagggaggaggactccgaatggatctccccattcctggcgggaagcagactgatatatagaggagggggtttgaagaggtggtatttgatttacatagagcccaagggattggtttgaccaggtgtgccatttacatagccctcgaagaaactggccattccaccttgatcttttattatgcagatagggttttttacttggccagagccttgacacctgcacacatggcaacaaacagaagggaggcgaaatcttccatattggatgcacctgtcttccaggtgcagctgccggcatttatctgtgcaagcttctagcttgcttatttatgcttgcagcttgacttttcaggctgctttctgttggaaaagaaatggttttgggggctgctttttattaaaagaaaagccttaccaaggactcctgtaccctatctgcctaaattttttttaactactatattaaaaggtctgtaagtgggagctggccctaaaagtaggttgtagagattatttggatgtgccaacaagcttcatctgcagcttggactgtctccattggaaggcctctggcagattttgtaaaaagttatataacaattttactataggaaaaacttggctacagatatgaatttatattacccatcattggctggttccttatcctgaacattggtttccttggaatctgattttggcttgtttggcctttaaaaaccccagaagaatggggtttctgccagattattttctggttttcagtctcactgaatgtcacaaaggccttggtttatggttcccaactggtaaagaaacgtcaaactttgcctctcttagttccttctacatgacaatgggtggcagttgctcatatggaagcatttcttttccccctaaagcctatgagacaggctgcaacttaaacccctattttattaaaggagaggaaatgtccaagagcccagagatagtgggtaaaagcatcataaggactagaaatggggtcttcttgttgctaattagtaggggtgaggggtaagtggcagatgtgactgccgtccatgcccagacagggaattgtccttgaacctactcatgcggtgtcttctggggtacagtgagtccacagggcaggacggccttggagtcaagagcccagactcacattctatctcaggcttcataactcaattgctccatgaccttaagccaatttagttccctcatctgtaaaaatggggataacaactgaatttacctcatgggattgtgtaatgcccaaccttgtttttactaaccctgtttttagactctccctcttcctttaatcacctagccttgtttccacctgaattgactctcccttagctaagacagccagacagactccatcttggctctttcactggcaccccttcctcaaggacttaacttgtgcaagctgactcccagcacatccaagaatgcaattaactgataagatactgtggcaagctatatccgcaattcccaggaattcgtctgattgataacgcccaaagccccgggtctatcaccttgtaatagtcttaaagcccctgcacctggaactgtttactttcctgtaaccatttatccttttaactttttgcctactttatttctgtaaaattgttttaactagacccccccctcccctttctaaaccaaagtataaaagaaaatctagccctttcctcagggctgagaaaattttgagtgttagccgtctctcggtcgctggctaataaaggactcttaattcgtctt

SEQ ID NO: 16312 - DNA, 3433 bp, Homo sapiens
ccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctccagggaaggcaaactctactgcaagaacgacttcttccggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcggccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtctggttccagaaccggcgctccaaggagcggaggatgaagcagctgagcgccctgggcgcccggcgccacgccttcttccgcagtccgcgccggatgcggccgctggtggaccgcctggagccgggcgagctcatccccaatggtcccttctccttctacggagattaccagagcgagtactacgggcccgggggcaactacgacttcttcccgcaaggccccccgtcctcgcaggcccagacaccagtggacctacccttcgtgccgtcatctgggccgtccgggacgcccctgggtggcctggagcacccgctgccgggccaccacccgtcgagcgaggcgcagcggtttaccgacatcctggcgcacccacccggggactcgcccagccccgagcccagcctgcccgggcctctgcactccatgtcggccgaggtcttcggacccagcccgcccttctcgtcgctgtcggtcaacggtggggcgagctacggaaaccacctgtcccacccccccgaaatgaacgaggcggccgtgtggtagcggggtctcgcacggtctgcggagttcgtggttgtacagaaatgaacctttatttaagaaaaatagaaaaaaaaaaaaacataaaaagcaagtccccacccccttcctccagcctcgagaaccattctccttctggggagaccggatggaaaagggggacacgaaataggatccaaatcggcctcgaggtgggactgggatccgcgcactggctgtcgacgtgcagaactggggctccccaaaggaaacgcagacctctccccaactcccacctggacccggatccgtagacagaccccgcgggcgtgtgcgcctggcaggcgggcggcgaaaagacgtccagggcagccgcgggtgcgcacagccgttggcgatgccaggagccgtggggagggaggccgtgagcacagccgggtgaaggaagtgaagcggcccagggcgctcccgggccagccaggagggttctagctctgggatatcccttattagtgttgtctcagagttcaacaacagcgacaaaaaactcttatagcttcagaaacgccgacctgccgtgcatcaggtgggactatatatatattttttgtctatctggatttttggtttttgtttttgccaaaattgcaaaattctaaatgtaaagccctccgtatcaactcttctaccttcgcaaaactacacatacacacatacacacgtacacggacacactcggtaagatggtctccagccagaccgctcagtaaaatgacttgaacatcagctgtacaagaaaagtattctaccttcacacacaaaaagttaaaaaaaaaaaaaaaagactattgaactaaaaacagtcaactgtttacgtataatgttaaattcaggagttcagtgttttactaatatatcctgttttgaaacctcttgttcgaaaacaaaatgttttgagcaatcaaccaaaattgttccttttcttttcctgtagatgttctgacagatttgcagggctttcggctcactgtgctagtatgtaaaaaggtgttgtttacacgaggcaaagagaaaacatgctattcagacagttgccaaatagaataattatagcacaaatactgtaaaggtgcctggcaccagcaacctgagaaagtgttaaaaaaaaaaaaaaaaaagtgttacaagatttaaaaaaaaacatctttgctaatttttttgtcctgttgaacattcatggaattgttaatatgacttatatagacccacacaggttttatttttgtgtctttaaaataaaagtccaaaatatttaaattttatggtcaaatatgcagtcaacagctgctactttttctttatatattaaatttctcatatgtcttttattgttctaataaacctaagcttgtgtgacctccagtgcatattagaccattcactgtatgaaagaaaacatgttgaataaatttgtgagtttttaataaaaatagaaaatctgatgtttagataa

SEQ ID NO: 16313 - DNA, 2554 bp, Homo sapiens
gactgcagagccggggctgggctaggcgcgcgcttggagagcattgcgcgcggctgggcccgcggccggcggctcctcctcccactctgctcctcctcttttttctcctcctccacctcctcctccgcctcctcctcctcctcttcctcctcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagccgggcgggcgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcgtcctgccccgcgagcgcccggggcccggagcccggcctgggggctcagccgagctcgggcggggccggggccgcggtggcgatgcaccgggcccgttagcgccaggagcgccaggcagctgaggcggggggcaagccctccctcggaggagccgcgcccccggccccgccggtcccgccgcgatgctgttccacagtctgtcgggccccgaggtgcacggggtcatcgacgagatggaccgcagggccaagagcgaggctcccgccatcagctccgccatcgaccgcggcgacaccgagacgaccatgccgtccatcagcagtgaccgcgccgcgctgtgcgccggctgcgggggcaagatctcggaccgctactacctgctggcggtggacaagcagtggcacatgcgctgcctcaagtgctgcgagtgcaagctcaacctggagtcggagctcacctgtttcagcaaggacggtagcatctactgcaaggaagactactacaggcgcttctctgtgcagcgctgcgcccgctgccacctgggcatctcggcctcggagatggtgatgcgcgctcgggacttggtttatcacctcaactgcttcacgtgcaccacgtgtaacaagatgctgaccacgggcgaccacttcggcatgaaggacagcctggtctactgccgcttgcacttcgaggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggcggccgaggaaacgtaagagcccgggccccggtgcggatctggcggcctacaacgctgcgctaagctgcaacgaaaacgacgcagagcacctggaccgtgaccagccatacccgagcagccagaagaccaagcgcatgcgcacgtccttcaagcaccaccagcttcggaccatgaagtcttactttgccattaaccacaaccccgacgccaaggacttgaagcagctcgcgcaaaagacgggcctcaccaagcgggtcctccaggtctggttccagaacgcccgagccaagttcaggcgcaacctcttacggcaggaaaacacgggcgtggacaagtcgacagacgcggcgctgcagacagggacgccatcgggcccggcctcggagctctccaacgcctcgctcagcccctccagcacgcccaccaccctgacagacttgactagccccaccctgccaactgtgacgtccgtcttaacttctgtgcctggcaacctggagggccatgagcctcacagcccctcacaaacgactcttaccaaccttttctaatgactcgcaacccctcaccccacaatttctttaaaaaagaaattatctttagttgaattccaagtgtattttaaaatagaggctttgagcaactaactaaccacattttaggatctcgcctggaaacagaggtaaaaaaaagaagtgtgcgcccggctaatgcagcggtgtggaccgaggaacaacttggaagatctacctgcaacacaacatttgtgtcactgtacagttttgtggactgagcgaggaaaaacaacaaataatttaagttggctagagcttctgtattttcaaagactgccacgtgccttaggaatactgttttatctccatactttggatgacttgttcatttttctctccctctttttctctgtatatttatgaccagagcaaaaatgtaaaaaacaaaaaaaacaacaaaaaaagtttgttactttgaatagtcctaaaaagaaaaaaagaaaaaaaaaaaaggaaaaatcaaaccccctccaacggtcgctttgttgttttagaattttaaggtggaagtctgttcgaatatcagaatttgtaaaatctaaccagtaataaaaccacttattgaaacta

SEQ ID NO: 16314 - DNA, 1313 bp, Homo sapiens
cgcagcgcccagcagcacccggagtcgcttggacgccggttcggggctattgcggggtggcgtcgctgggcccgggaaagttcgggactggagagtggcgacgccgggcggcgggacccatggaggcgcgcggggagctgggcccggcccgggagtcggcgggaggcgacctgctgctagcactgctggcgcggagggcggacctgcgccgagagatcccgctgtgcgctggctgtgaccagcacatcctggaccgcttcatcctcaaggctaccgccactggcacagcaagtgtctcaagtgcagcgactgccacaccactggccgagcgctgcttcagccgaggggagagcgtttactgcaaggacgactttttcaagcgcttcgggaccaagtgcgccgcgtgccagctgggcatcccgcccacgcaggtggtgcgccgcgcccaggacttcgtgtaccacctgcactgctttgcctgcgtcgtgtgcaagcggcagctggccacgggcgacgagttctacctcatggaggacagccggctcgtgtgcaaggcggactacgaaaccgccaagcagcgagaggccgaggccacggccaagcggccgcgcacgaccatcaccgccaagcagctggagacgctgaagagcgcttacaacacctcgcccaagccggcgcgccacgtgcgcgagcagctctcgtccgagacgggcctggacatgcgcgtggtgcaggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccgtgagccttccttggcggaaatgggcccggccaatggcctctacgggagcttgggggcacccaggccttgggccggccctcgggagccctgggcaacttctccctggagcatggaggcctggcaggcccagagcagtaccgagagctgcgtcccggcagcccctacggtgtccccccatcccccgccgccccgcagagcctccctggccccccctcctctccagcctggtgtacccagacaccagcttgggccttgtgccctcgggagcccccggcgggcccccacccatgagggtgctggcagggaacggacccagttctgacctatccacggggagcagcgggggttaccccgacttccctgccagccccgcctcctggctggatgaggtagaccacgctcagttctga

SEQ ID NO: 16315 - DNA, 2403 bp, Homo sapiens
cgcagcgcccagcagcacccggagtcgcttggacgccggttcggggctattgcggggtggcgtcgctgggcccgggaaagttcgggactggagagtggcgacgccgggcggcgggacccatggaggcgcgcggggagctgggcccggcccgggagtcggcgggaggcgacctgctgctagcactgctggcgcggagggcggacctgcgccgagagatcccgctgtgcgctggctgtgaccagcacatcctggaccgcttcatcctcaaggctctggaccgccactggcacagcaagtgtctcaagtgcagcgactgccacacgccactggccgagcgctgcttcagccgaggggagagcgtttactgcaaggacgactttttcaagcgcttcgggaccaagtgcgccgcgtgccagctgggcatcccgcccacgcaggtggtgcgccgcgcccaggacttcgtgtaccacctgcactgctttgcctgcgtcgtgtgcaagcggcagctggccacgggcgacgagttctacctcatggaggacagccggctcgtgtgcaaggcggactacgaaaccgccaagcagcgagaggccgaggccacggccaagcggccgcgcacgaccatcaccgccaagcagctggagacgctgaagagcgcttacaacacctcgcccaagccggcgcgccacgtgcgcgagcagctctcgtccgagacgggcctggacatgcgcgtggtgcaggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccgatgagccttccttggcggaaatgggcccggccaatggcctctacgggagcttgggggaacccacccaggccttgggccggccctcgggagccctgggcaacttctccctggagcatggaggcctggcaggcccagagcagtaccgagagctgcgtcccggcagcccctacggtgtccccccatcccccgccgccccgcagagcctccctggcccccagcccctcctctccagcctggtgtacccagacaccagcttgggccttgtgccctcgggagcccccggcgggcccccacccatgagggtgctggcagggaacggacccagttctgacctatccacggggagcagcgggggttaccccgacttccctgccagccccgcctcctggctggatgaggtagaccacgctcagttctgacccaggcccggctccaccctgcacctcacacgagggagctgcccctgggtgggcggctcggggctgctggggtttccgaggaagtggggccagggcgtcaagggagggctggtgccttcggagcctcccactgccgaccgcacagctccctctctgggggctgagggacccacctggcccctcctctgacacagggctggcccgccaggtggcctcccagcaagccagccttttttgtaagcaaatttctcccctttattgaccaattaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctccgggagaggccccctcctctccccagaccacagggggcctctctgcctccagccccaccttccccgggagaagctttccccaatccccaggtctctagatcattctgttctcgagtatcctgtggaggaggcaaaaatgcctggcgccccttctctccaagctcaattctctaagcccctcagggtctcctcctcaccccaccccaggcccttggtgtccaggctgcacccacagatgtctgttgccaaacagcctgccctccctgccggagccggctctgccagccccagattgggaagtctccccgctggagaagggtggggctcctctgagcctgccctgcctcctccatcagatcctttgggaagaagtttctgggagatgcccgcagctgtgcgtgccccagacacaaaggctggcctgtgtgtaagtcaaagtcactcccgcaaacctgaatctcgagctacctattggttctgtgaatgttctgtgtcttttatttattctcgggtgatcagctctttccaagacttcaataaatttgtcagttacagtcaa

SEQ ID NO: 16316 - DNA, 2337 bp, Homo sapiens
gccccgcacgacgcggcgggacttgggagccccgaaccctccaggggacgctgacctaggaggagcgcgtctcgcgccactcggcctggtggccgcgatgctgctggaaacggggctcgagcgcgaccgagcgaggcccggggccgccgccgtctgcaccttgggcgggactcgggagatcccgctgtgcgctggctgtgaccagcacatcctggaccgcttcatcctcaaggctctggaccgccactggcacagcaagtgtctcaagtgcagcgactgccacacgccactggccgagcgctgcttcagccgaggggagagcgtttactgcaaggacgactttttcaagcgcttcgggaccaagtgcgccgcgtgccagctgggcatcccgcccacgcaggtggtgcgccgcgcccaggacttcgtgtaccacctgcactgctttgcctgcgtcgtgtgcaagcggcagctggccacgggcgacgagttctacctcatggaggacagccggctcgtgtgcaaggcggactacgaaaccgccaagcagcgagaggccgaggccacggccaagcggccgcgcacgaccatcaccgccaagcagctggagacgctgaagagcgcttacaacacctcgcccaagccggcgcgccacgtgcgcgagcagctctcgtccgagacgggcctggacatgcgcgtggtgcaggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccgatgagccttccttggcggaaatgggcccggccaatggcctctacgggagcttgggggaacccacccaggccttgggccggccctcgggagccctgggcaacttctccctggagcatggaggcctggcaggcccagagcagtaccgagagctgcgtcccggcagcccctacggtgtccccccatcccccgccgccccgcagagcctccctggcccccagcccctcctctccagcctggtgtacccagacaccagcttgggccttgtgccctcgggagcccccggcgggcccccacccatgagggtgctggcagggaacggacccagttctgacctatccacggggagcagcgggggttaccccgacttccctgccagccccgcctcctggctggatgaggtagaccacgctcagttctgacccaggcccggctccaccctgcacctcacacgagggagctgcccctgggtgggcggctcggggctgctggggtttccgaggaagtggggccagggcgtcaagggagggctggtgccttcggagcctcccactgccgaccgcacagctccctctctgggggctgagggacccacctggcccctcctctgacacagggctggcccgccaggtggcctcccagcaagccagccttttttgtaagcaaatttctcccctttattgaccaattaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctccgggagaggccccctcctctccccagaccacagggggcctctctgcctccagccccaccttccccgggagaagctttccccaatccccaggtctctagatcattctgttctcgagtatcctgtggaggaggcaaaaatgcctggcgccccttctctccaagctcaattctctaagcccctcagggtctcctcctcaccccaccccaggcccttggtgtccaggctgcacccacagatgtctgttgccaaacagcctgccctccctgccggagccggctctgccagccccagattgggaagtctccccgctggagaagggtggggctcctctgagcctgccctgcctcctccatcagatcctttgggaagaagtttctgggagatgcccgcagctgtgcgtgccccagacacaaaggctggcctgtgtgtaagtcaaagtcactcccgcaaacctgaatctcgagctacctattggttctgtgaatgttctgtgtcttttatttattctcgggtgatcagctctttccaag

SEQ ID NO: 16317 - DNA, 7083 bp, Homo sapiens
aacctgggatgtgcaccaaccccggagagcgagatcaaagggactggaaacagactggggactggcggggggagggggccggccagcctgtggagtcctccctgagaagcggagggcccggcttccaccgtgactccagcggcctgcttggggttttaattattattttgaaatttctgaatcgagctagagcgagagagcgagagatctccgtagactgcgactcgctggctttcgctccgagatgatgcagagtgcgactgtccccgcggaaggggctgtcaaggggctcccggagatgctaggtgtgccgatgcaacagattccccagtgcgctggctgcaaccagcacatcctggacaagttcatcctgaaggtcctggacagacactggcacagctcctgcctcaagtgtgcagactgccagatgcagctggcggacaggtgcttctccagggctgggagcgtctactgcaaggaggacttcttcaagcgcttcggcacaaaatgcacggcctgccagcagggtatccccccaacccaggtggtccgcaaggcccaggactttgtctaccacctgcactgctttgcttgcatcatctgcaaccggcagctggccacgggggacgaattctacctcatggaggacgggcggctggtgtgcaaggaagactacgagacagccaagcagaacgatgactcagaggctggagctaagcggccccggaccaccatcacagccaagcagctggagacattaaagaatgcatacaagaactcccccaagcctgcccggcacgtgagggagcagctgtcctcagagacaggcctggacatgagggtcgtacaggtttggtttcagaacagaagggccaaagagaaacgcctgaagaaggatgcagggcggcaccgctgggggcagttctataagagcgtcaagaggagccggggcagcagcaagcaggagaaggagagctctgcagaggactgtggggttagtgacagtgagctgagcttccgagaggatcaaattctctcagaacttggccacaccaataggatttatggcaacgtgggggacgttacaggcggacagttaatgaatgggagcttctccatggacgggacaggacaatcctatcaggacttgagggatgggagcccctatggaatcccccagtctccatcctccatatcgtccctgccatcccacgctcctttgctcaatgggctggattacacggtggacagtaatttgggcatcattgcgcatgcagggcagggagtaagccagacgctgagagccatggctgggggacccacctctgacatctccacaggaagcagtgtaggctatcccgactttccaactagcccaggctcttggctcgatgaaatggatcatcctcctttttaaacttctctcctccccaccctacctgcccccctggcttgagagaatatcttcaaggatcaaaagagacttgccttttaaggatcgaaagtacgccaatgtgaatttccattattttcaatggaagtcctccgctgattcctagaaggctgtgagaccacactagggcattgtttccctggggaagcagtgggagagcagactcatctcagaacacagcacagggggtaatggcctagagctctagggacactggcttgttgggtctctcccctgctgttctgcttaggggcttggctgctcagtgctttggtagcacaaggtgactgtgataggcccccttggcctttgggaactttgctccaactggtgtgtctcacacaatgcctcccaaaacactgctctcaccagaactgagactcctaaggtagaggcctcacagcccttgagtaaaataaaagtgatttctggaccatccttattgaaccctatatttcaaaatgaaaagatcagttattaaaggtcagtgaacactttgatggccagtttgatattaaaaacatgccccctccttttttatttttgctgtgaagatatgaattctttcctacaaaccagagaatatgaacctgttttggtttttaagtgtcccatctatatcattgactctgatggcaagaggtggttttcattgcaggtgactgaggctgagctgagtagccctggaccaccgctgcagattgcctgagtcgtccccttggtgcacagtgtgccttcttcaattgcttgtatcatttattccacaagacaggctgtgggctgtaaaatgagcaaaactaaaatgtggggagaacaaaatgacaatcaatcagtgaacatttgtagacacatttggattccaaacctgcagtctgttcagccatatcggctgatgccagtcttccagagttccccatcccttgtagggtgaaatatttggagtctgttttgaaggagttggtttagatgagcttgcaagtctacccctctgaaagctttctctgctgtcctagctgactcaattggaggacagttttggtcatttccaggaaccagcaatttttttttggcctaccttggttgggaagagtaatttagggagcagccctaaaattgtccaaagggttctaagtggttcttgggctgcatctctctggattgctggctggacacctgccatgccttgggctgcagtcccatggtcagaaagccagaactctctggccagtggtggtgcagggactccccgttgtgcaggtttgcagtagcaaatcactaagcctgaggccagagcaaggccaacccccgctttacgagttgccactcctgcgacagactgcactgctgtgggaaacgctgtcctgaatggtgctgcagctcccacccaccttgtgcacccatctaccatcaggaagctctccatgtgcaaactggaatttagccagctggaatttattcctgtccctctgggaagctgtgtttgcttcttctggcctcccattctcttaaatgagatcagcagagtaggaaagggtgagaaggcattgcctatcacatgaagtgatggggccagagaccctaaggacccttccttctacgaatggttggtcaccttttgaggactgcaaagacttaggcatgtcataggcagactaaaggaagaatacacagttcctcttggactgctacatcttttgtaagcccttttccaggactaaactaagttcaattaagtaagttctttaaaacagtaaattccgggatcagccttcgggccctcttctctgaccaattttatagcgtaccctcgttttttggtgtgctgcagtggtcatgatttttgcttgagaagtctgcaaacatagacacttctcttgaggttccatgtttatggatgatgttgtgttaatcctagccaattctgtgctattgggaattctccaatcatgaacactggggtggggaggaagacacaaatgccatgtgaggaaaggaaaatgcagtcgtctttttggaggatggctttttaaatacacccttcttagcaggctgcttaaaatacacaggagaaaaggctctgctgggcaatgaaccagatgaaaagctgcccacccagatcactgttgcaggttgactatttggcttagcaactcatgggatttcagaggcccttgaagtttttggtgagtatagtgtgggggagagcaggctttttaaaaggggggggggcatcctcctctgtgtagcactgtttaagatcactgtaagtaagttgaccagtttttgtaagttaatcatactaattcccagttcaatagtggaaggagaggccttcctcatttatactaataatataataaatctcttgaggaactcagtgagcagttgacgaggtcaatagttctttggcatcagtagggctggttagctggaaaaacccttgagagcactggcctgaaaaccaggagagctttgttttccagagccacctccccagaaagcagcaaacactgctgcctgtttagaagcacagccacagtaggtctaagattttaaatggatctccctacaggttgggttagcattatgggtgggctggtgccactaatgagccattgcatgacaggactcttctggggtttggaaatggagaaaagccgggcattcattacttttagcttctcttagaggcactcctctgttgcttggaagtctattatggggtataaggtgctacatggtagctgtttccccccttgctaaaatgacatggatgaattttaaaaatgaaatgagaccttctagaggcaaccattatctgcagtgcctggctggtcgactttagagtaggaagctcttgaatccaggagcaaattagttaaaaccccaagttccagtggtaactggtataagcaaaatggaaactgaggggctatggaggaatctctgtttgttggaacgtaatgaaaccatggaggaaataccagatttaagggctaagaagctggcccgatgggtaaatcagtgttgggagtcaggttcttggcccttcaaggacttgctatgcaacctcaggcaaattcctctcagtctttgtgctttctctttcttgtctcatctgacagttatgaatataacgtaaaataaagatcaactatcattgataacactgttcctgcaaatgaatactgtgaaacatcagggaaagaggaaaaaattaagccacaagaaaaccatttggcagtgtccttaaactttttttgggggggggcagtgtaaaacatgaaacctagtaagataattgggccattagatcttcatcattaaactcactttgcaaggaagtgtaagaaatctgtaaaacaaaagacattcctatctcagaagctcaaactggtgatttccaactgcctctttacaggagggggctcaaggcttctgatgagcaaaggctgtgtgttgtatgacagtccactctctgcacctacacttccacgtgccacgactgacaacttggttataaccatgaaaataatgaccatacctccccagccagcagggtctggaaggcctgaggaggctcatttttaaacactgcactttaaaaattggaaaccgtgagatgaagaaaaattcaattaagcggaaatgagttttgttttattgcctgctgctgaagggctctgggcatgctgaaagctaaatgaaaagcacatcactggctctcttctttcttggattggtcaattggccctttttgcagtagttgctccaactgttctaaacagtgagtgactggagccaaaaagagagagctcagcaaagccatcccatccacactctgcttggtaggaccacactaaaagcacagtttcatgctgctagctctggtaaggagacagctgcaggtttgggaggtgcaccaagcattcctttgcttagggaggcagagcacaggtgaacagaggaaggacacccccactctcatctattgcccaccgagaggcaagaatcacaccaactttcccacttgaggactgtgttcggccaaacaagcaggttcagggctgcgggattccagaagttgctctgagcttgcaatcagacctcaaagccccagatcccctcagctctggatcgttgccctcatccttcacaatgtaaattttgtacagttaaagagaaatgaagtctcgtttcctggggaaaaaaaagaaaaaaagaaaaaaaaaagacccacccatccttatttattgccatatgactttggaaaacagaagctggtgcgtttgtttgtatatgcctcctgtgtgttggcatgagatgtgtacggtaaaattatgtaaaataaatatggaaattctttagatgctgatgtgtcttgcttttcatttggtttgctggaagttttttctcttgacataaatagaataaaaactgagtgatgtgaggtcctttccttttatcatcagaaggaaaccaaatatacaactctgaatgccagaactattatacttagagccatgaaataccagaaccactcaataaaggactgattagaggaagttccctggtttttctaatagtcatttcctgggcacgatcctctgcccccagacttaggaaatgagcagtagaaatgttgaccatataacttttagttcctgtttgttcagtggcatttttaaaatttttttttgagacagagtcttgcgctgttgcccaggctggagtgcagtggtgtgatctcagctcactgcaacctctgcttcctgggttcgagtgattttcgtgcctcagcctccagagtacgtgggattacaggcatgcgcaaacacgcctggctaattttttgtatttttagtagagacggggttttgccacgttggccaggctggtctcgaactcctgacctcaagtgatccgcccacctgggcctcccaaagtgctggaattacaggtgtgagccaccatgcccggcctgtccagtagcattttaaaagtccttcacactcatacatttttctttctagagaaagtatatgcaaatgtctatatttacagagggacagaaacacctcatcagagtcatcagggctcctggacaaacattttccaggagaatctccatttaggtttgttttctctgcaggagtctttattagtgtgcagaccctaagtttagctggaatggaaacagcaacagggactttttcattacattaaaaaaaaaaaaagtcatagcatttctttacagctgggattccactgtggaaaaactacagcgtgtttcttttccccactagtcattagttttgtttggctgaagagaagatccaaagcagtggcactgtccaatatggtagctactagccacacatggctatttaaatttaaattagtattaaataaaactaaaagtttagttccttacactagacacattttaggtgctcaacagcttcatgtgaccagtggctactgtatttggacgacactgatataaaacagttctatcattgcagatggctctactggacggtgctcatagagtcttgttagggagagtgggcaaggaaatctcattcatcacatgtttagctattagttatcctggaatacttggtgaa

SEQ ID NO: 16318 - DNA, 2940 bp, Homo sapiens
aaccaggtacaagctaatactcaacaatactgatgccttgttttttttgctctgtccggacagcaacgctgtagccaatttagatatgctataaatttaagaggttgccatggccacggtgcgcccattggccgctgggccccctacgtgcagcgccacgtcaccaaatctgaataaggatgcgcgaattacgcggcgaccagacaaagatgaggatccggaccgcttgaaagtgggggaaagtgccggcgcctccgccaccggggaaagccgctccgcagcgccgaggccagcagccacccgagatacctggggaagcccggaacaggcgccggggcgtgcggcccgtggcatgaggttgtgaacgccacccgccccccaccaccccactccgggcagcccagcgccaggccagagattgcccaaggactggaccggctgagtcttggtccggaccagactcgccctgcagctgctgagacaagaggcgaagggcagcggagggcccggcaggcccgagggccaggggcccaaagggagggcaaggcggccgaagccgccggggcgcggggctatgatggtgcactgcgccggttgcgagcggcccatcctcgaccgctttctgctgaacgtgctggaccgcgcgtggcacatcaaatgtgttcagtgctgcgagtgcaaaaccaacctctcggagaagtgcttctcgcgcgagggcaagctctactgcaaaaatgactttttcaggcgctttggcacgaaatgcgccggctgcgcgcaaggcatctcgcccagcgacctggtgcgcaaggcccggagcaaagtctttcacctcaactgtttcacctgcatggtgtgtaacaagcagctgtccaccggcgaggagctctacgtcatcgacgagaacaagttcgtgtgcaaagacgactacctgagctcatccagcctcaaggagggcagcctcaactcagtgtcatcctgtacggaccgcagtttgtccccggacctccaggacgcactgcaggacgaccccaaagagacggacaactcgacctcgtcggacaaggagacggccaacaacgagaacgaggagcagaactcgggcaccaagcggcgcggcccccgcaccaccatcaaggccaagcagctggagacgctcaaggctgccttcgccgccacgcccaagcccacgcgccacatccgcgagcagctggcgcaggagaccggcctcaacatgcgcgtcatccaggtgtggtttcagaaccgacggtccaaagaacgccggatgaaacagctgagcgccctaggcgcccggaggcacgccttcttccggagtccgcggcgcatgcgtccgctgggcggccgcttggacgagtctgagatgttggggtccaccccgtacacctactacggagactaccaaggcgactactacgcgccgggaagcaactacgacttcttcgcgcacggcccgccttcgcaggcgcagtccccggccgactccagcttcctggcggcctctggccccggctcgacgccgctgggagcgctggaaccgccgctcgccggcccgcacgccgcggacaaccccaggttcaccgacatgatctcgcacccggacacaccgagccccgagccaggcctgccgggcacgctgcaccccatgcccggcgaggtattcagcggcgggcccagcccgcccttcccaatgagcggcaccagcggctacagcggacccctgtcgcatcccaaccccgagctcaacgaagccgccgtgtggtaaggccgccgggccgccccccgcgctcggcccccgggggccccgccccgaagcagcctcctgaaaccaaaacgcccgacgcagacgcggtgggagacgtgggtgtccctcgggggttctctctcgggtccgcactcaactggcagctgctcctcggctgggcgccgagggggggccgacccccatctccaccccgcgggctctccaggagcctcagcccaccgccagtactctcccagcaaccgcgagcaatttcttgggaccaaagtcaatactccggagggtcaagagatttcgagcacgctctagactttccccgggcccccacccacccacccagccaccgccacctctttggactgagagagggtgaggccaaggggcggagacggtgtttttccctctctctgcaatccgagtggcattttgtaatcttatttctcgctgtgctttccccgtctttaaaaaaaaagatgataagaaaaggagagagattgaaagagagggagaggaaagggggcaagatgaggaggagatggagagacagcgtcagccagagggagaagacggagagcgagcgaggaactcgcgtgaaccgggagccaccgagagggagaccgagccacctgcacgctggcgctccctggtggccaatcttgaggctcaaggtcagcttctctaggaatagggctgtgggtcaggaagtggccagccgggtccagctcccgctcttccttactttgacgtttatgttgagcccgagggagcaggccggactcgaacacgcacacatcctgctctccccctgggtggggcgccaggattgctgggctcagacccacagaccaccctccctgcccagggcctggaggctgggccgtcaggatgtacaatattatacttttttggaagttgaacgcttctagtttccttattttgtataaagaagaaacaaataaagtatgtttttgtgtttactgtttatttattgtactctagttatccggggttggacatttttatatttttaagaggaggtagggcagagtgacggaggggaagcagaaagaggtttacctaaaaaaaacaaaaaacaaaaacaaaaaaaatcaactttttttaaagagaaagattaataaaaaaaaatcttttttccctca

SEQ ID NO: 16319 - DNA, 2373 bp, Homo sapiens
agaggcaagaggctagcggctggaccacttgtgctggagtggtaaagaactatcatgaatccatttactgaaagtgtccatttctgaactcaccctaaagaggacaaacaccgcaaagtagttaaaagtcaggcattcgcgtcggacgtctgggtttgaattctgccctggcttgactggaaacgcttcccctatttcttccgtagcggaccgggagagcttactggcgctctgcgaaccggctggaaagaaacaccgagtcactcgtacagactcttggtcgcagaacttggctttccgctattggtcctccagaaccgcttgaaacaactggccccagctggcgcatcagaccgcagtgaggaatgccgcggggcgggtggcgaaggcagggtctgcccgccagtggattcccgggtgtcccgcgtggagcaggcttgcccagctgggaagcccatcaaacctcagtcttggcccacagtgggagagagaccagtgggtcccagacggaggccctcgcccgcttttggcgacctccactggcgtgaataaaagcacccctctcttaccctcagaaactgtgggtagcaaggtataaaacggagtctgggaccggtaagtcccaaggtgagcccgtatacagctctgccatctctgaggggttatgcagattctgagcaggtgtcaggggctcatgtcagaggagtgcgggcggactacagccctggcggccgggaggactcgcaaaggcgccggggaagagggactggtgagccccgagggagcgggggacgaggactcgtgctcctcctcggccccgctgtccccgtcgtcctcgccccggtccatggcctcgggctccggctgccctcctggcaagtgtgtgtgcaacagttgcggcctggagatcgtggacaaataccttctcaaggtgaatgacctatgctggcatgtccggtgtctctcctgcagtgtttgcagaacctccctaggaaggcacaccagctgttatattaaagacaaagacattttctgcaaacttgattatttcagaaggtatggaactcgctgctctcgatgtgggagacacatccattctactgactgggtccggagagccaaggggaatgtctatcacttggcatgctttgcctgcttttcctgcaaaaggcaactttccacaggagaggagtttgctttggtggaagagaaagtcctctgcagagtacattatgactgcatgctggataatttaaaaagagaagtagaaaatgggaatgggattagtgtggaaggtgccctcctcacagagcaagatgttaaccatccaaaaccagcaaaaagagctcggaccagctttacagcagatcagcttcaggttatgcaagcacaatttgctcaggacaacaacccagatgcacagacactccagaaattggcagaaaggacaggcttgagcagacgtgtgatacaggtgtggtttcagaattgtagagcacgccacaagaaacacgtcagtcctaatcactcatcctccaccccagtcacagcagtcccaccctccaggctgtctccacccatgttagaagaaatggcttattctgcctacgtgccccaagatggaacgatgttaactgcgctgcatagttatatggatgctcattcaccaacaactcttggactccagcccttgttaccccattcaatgacacaactgccaataagtcatacctaattcttttttcagggatagacttgattaaggatataaatttgtcatttattatgtataaaataccattgaaaagatattactgttaattttttatttaacacctaaagcatttccaacatcactttgctgcccaggtatgtatctatagttggcctgcaagacacttttattaattcttcattttttgtaaaacttatgtttacaagaagaaaacaaatcaaaacattttttgtattgtctggaaatagttcactctagtgtgtatctgttaatttatttgtcatcaaaagagcactttgcctaaaagaaaggactgacaagtgtgcaaaatgtttacaatcttttgtgaaattgtagtttatcattagtttgtatctgtaagttattgtaataaatattacctgtattttttgttatatacaactttatactttgaagcttgtatctgtgaatttgcaactgaaatttattttgccaatgttttctgaatgaactgaataaagcttctgttgtagcatgccatgcaaacacattattgtgtttgtggttgatgaattatggctgtaaataacactatagtttaataagcccaccattctgagtttattaaacattttccattcttgtgaaaatttcaa

SEQ ID NO: 16320 - DNA, 1764 bp, Homo sapiens
ctcacttaacctgagacatggagactgtaatttgggagatgaagcctcgagcctaaggcgctctcaggtccattgtcaggggctcatgtcagaggagtgcgggcggactacagccctggcggccgggaggactcgcaaaggcgccggggaagagggactggtgagccccgagggagcgggggacgaggactcgtgctcctcctcggccccgctgtccccgtcgtcctcgccccggtccatggcctcgggctccggctgccctcctggcaagtgtgtgtgcaacagttgcggcctggagatcgtggacaaataccttctcaaggtgaatgacctatgctggcatgtccggtgtctctcctgcagtgtttgcagaacctccctaggaaggcacaccagctgttatattaaagacaaagacattttctgcaaacttgattatttcagaaggtatggaactcgctgctctcgatgtgggagacacatccattctactgactgggtccggagagccaaggggaatgtctatcacttggcatgctttgcctgcttttcctgcaaaaggcaactttccacaggagaggagtttgctttggtggaagagaaagtcctctgcagagtacattatgactgcatgctggataatttaaaaagagaagtagaaaatgggaatgggattagtgtggaaggtgccctcctcacagagcaagatgttaaccatccaaaaccagcaaaaagagctcggaccagctttacagcagatcagcttcaggttatgcaagcacaatttgctcaggacaacaacccagatgcacagacactccagaaattggcagaaaggacaggcttgagcagacgtgtgatacaggtgtggtttcagaattgtagagcacgccacaagaaacacgtcagtcctaatcactcatcctccaccccagtcacagcagtcccaccctccaggctgtctccacccatgttagaagaaatggcttattctgcctacgtgccccaagatggaacgatgttaactgcgctgcatagttatatggatgctcattcaccaacaactcttggactccagcccttgttaccccattcaatgacacaactgccaataagtcatacctaattcttttttcagggatagacttgattaaggatataaatttgtcatttattatgtataaaataccattgaaaagatattactgttaattttttatttaacacctaaagcatttccaacatcactttgctgcccaggtatgtatctatagttggcctgcaagacacttttattaattcttcattttttgtaaaacttatgtttacaagaagaaaacaaatcaaaacattttttgtattgtctggaaatagttcactctagtgtgtatctgttaatttatttgtcatcaaaagagcactttgcctaaaagaaaggactgacaagtgtgcaaaatgtttacaatcttttgtgaaattgtagtttatcattagtttgtatctgtaagttattgtaataaatattacctgtattttttgttatatacaactttatactttgaagcttgtatctgtgaatttgcaactgaaatttattttgccaatgttttctgaatgaactgaataaagcttctgttgtagcatgccatgcaaacacattattgtgtttgtggttgatgaattatggctgtaaataacactatagtttaataagcccaccattctgagtttattaaacattttccattcttgtgaaaatttcaa

SEQ ID NO: 16321 - DNA, 2503 bp, Homo sapiens
ggaacttgcaagcagccagggaacgctgaaaatagcacgtctttttctttctttgtgttcaaaactattttctttcttcaccagattttgttttcctccccccgctgcagttgtttcccattagtaactcgatctctcagagcagtaagattcgccttctacgcctctttttccctccgcccgaattgtttgttttctgcacatctccttcagggagccgctgaggcttccccccaactcttcccagttctttttgcttcccctcggccccccaagcagaccgatttccactccatctgtttcttctcctcctttctctccctctttccctccatcctcgagcgtctctgcgctcctacagggcagccctctctggtcccttgcctccttcactcggatgagctgaaagccccgggcgtgtgtatatggaaatagtggggtgccgagcagaagacaactcgtgtcctttccgccccccagccatgctctttcacgggatctccggaggccacatccaaggcatcatggaggagatggagcgcagatccaagactgaggcccgtctggccaaaggcgcccagctcaacggccgcgacgcgggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacagaaggttctctgtgcagagatgtgcccgctgccaccttggcatttccgcctcggagatggtcatgcgcgcccgagactctgtctaccacctgagctgcttcacctgctccacttgcaacaagactctgaccacgggcgaccatttcggcatgaaggacagcctggtgtactgccgcgcccacttcgagaccctcttgcaaggagagtatccaccgcagctgagctacacggagctggcggccaagagcggcggcctggccctgccttacttcaacggtacgggcaccgtgcagaaagggcggccccggaagcggaagagcccagcgctgggagtggacatcgtcaattacaactcaggttgtaatgagaatgaggcagaccacttggaccgggaccagcagccttatccaccctcgcagaagaccaagcgcatgcgaacctctttcaagcatcaccagctccggaccatgaaatcctactttgccatcaaccacaacccggatgccaaggacctcaagcagcttgcccagaaaacaggtctgaccaaaagagttttgcaggtttggttccaaaacgcacgagccaaattcagaaggaaccttttgcggcaggagaatgggggtgttgataaagctgacggcacgtcgcttccggccccgccctcagcagacagcggagctctcactccacccggcactgcgaccactttaacagacctgaccaatcccactatcactgtagtgacatccgtgacctctaacatggacagccacgaatccggaagcccctcacaaactaccttaacaaaccttttctaacattggttttttttttttagtttttaaattcttcctcttctttttattattattctaattattattattttattatttacaagactttttttttcttctaacccacaagatatttggggaataaaaataacagcttggtgtgtagcatctgcagccacttggcaaatgagtttacagtattgtctcctttaagtgaatatattttgtctacaaagtgtatttggatttaaaaaaattaattaggtctttcagttggtaaggagagtttttgaataattctaataagtgcctcttaaaattgtatgttacttatttccagaatctcgaagaaaaaagaaaaaagagtggtattattatgggcaaataatcatattcccacttaaatgattaggttaataaagaaccagataattaattagttactttttaaatcttgcaattgtatgtgtgattatggagttttgaaaacgttacattttttaaatcttaaaactgaaaacttgtttttagtatttctatttcttacctgaactgttaattcaagtgaggaatatgatgaaataaaagcattaactacagacattttaaatagtaatgattaattaggtgagaaatctattacaggaatgtgacttttccttctcttaggggtgtacaactctaaaaactttttacttggttatttgtttttcaacatttgaaaaatacttaagctccctatgtatccatgaaaattccgcattgattttgacattccatacttttaacctcctaaagctaaaaacaatagctcggaaaccattctttctagttactttttttcccagggaaaatggaaataagcaaaatataatgttttaagaagtaaaaaaatcaatataatt

SEQ ID NO: 16322 - DNA, 7413 bp, Homo sapiens
gcgtgatccactccttttcctctaagaatgctgaacggtaccactctagaggcagccatgctctttcacgggatctccggaggccacatccaaggcatcatggaggagatggagcgcagatccaagactgaggcccgtctggccaaaggcgcccagctcaacggccgcgacgcgggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacagaaggttctctgtgcagagatgtgcccgctgccaccttggcatttccgcctcggagatggtcatgcgcgcccgagactctgtctaccacctgagctgcttcacctgctccacttgcaacaagactctgaccacgggcgaccatttcggcatgaaggacagcctggtgtactgccgcgcccacttcgagaccctcttgcaaggagagtatccaccgcagctgagctacacggagctggcggccaagagcggcggcctggccctgccttacttcaacggtacgggcaccgtgcagaaagggcggccccggaagcggaagagcccagcgctgggagtggacatcgtcaattacaactcaggttgtaatgagaatgaggcagaccacttggaccgggaccagcagccttatccaccctcgcagaagaccaagcgcatgcgaacctctttcaagcatcaccagctccggaccatgaaatcctactttgccatcaaccacaacccggatgccaaggacctcaagcagcttgcccagaaaacaggtctgaccaaaagagttttgcaggtttggttccaaaacgcacgagccaaattcagaaggaaccttttgcggcaggagaatgggggtgttgataaagctgacggcacgtcgcttccggccccgccctcagcagacagcggagctctcactccacccggcactgcgaccactttaacagacctgaccaatcccactatcactgtagtgacatccgtgacctctaacatggacagccacgaatccggaagcccctcacaaactaccttaacaaaccttttctaacattggttttttttttttagtttttaaattcttcctcttctttttattattattctaattattattattttattatttacaagactttttttttcttctaacccacaagatatttggggaataaaaataacagcttggtgtgtagcatctgcagccacttggcaaatgagtttacagtattgtctcctttaagtgaatatattttgtctacaaagtgtatttggatttaaaaaaattaattaggtctttcagttggtaaggagagtttttgaataattctaataagtgcctcttaaaattgtatgttacttatttccagaatctcgaagaaaaaagaaaaaagagtggtattattatgggcaaataatcatattcccacttaaatgattaggttaataaagaaccagataattaattagttactttttaaatcttgcaattgtatgtgtgattatggagttttgaaaacgttacattttttaaatcttaaaactgaaaacttgtttttagtatttctatttcttacctgaactgttaattcaagtgaggaatatgatgaaataaaagcattaactacagacattttaaatagtaatgattaattaggtgagaaatctattacaggaatgtgacttttccttctcttaggggtgtacaactctaaaaactttttacttggttatttgtttttcaacatttgaaaaatacttaagctccctatgtatccatgaaaattccgcattgattttgacattccatacttttaacctcctaaagctaaaaacaatagctcggaaaccattctttctagttactttttttcccagggaaaatggaaataagcaaaatataatgttttaagaagtaaaaaaatcaatataatttaattaatagctctattaattggcttcagctgtaccatgatattgtatctggcattctatatgaataatgtttaaaatacccagcctggtagacttataccaacaattggttttgttttgttttattttattttgacataggttgacttatgtattgaaaataatttttctgatattagagatttgaagttattagtcttaaagtagataaactcagaagccttgtggatgctgatctgaatatatttcctagtttacagtagcatttttttcttttaatttaagctaaaatcttaatggtctgggcagtggtgaatgttcatctattacgcttctgttgtagttaaataccaattagattgtggatttcctaaaaaaataaaaaagaagtcaagatatatgtcttgctttagtggattgttaagaataactttgcacatattttccactttttggaccccttaaatctcctttggtggtcgaagtggctatttaatagattttaaaggtgtccttctggctgtataaatgtgtggttacatattgacagttcactgcccacattaaagtgcattattgtaacttttgctcagggtctttagaaaattagcacagaaagtagcttattttttaaaaaaagatgatggaagataagttaacactgtaacagaagaaaggtgtgattgccattatatatttagcaagtatggttatcatcttatatggagcttaaatcttgacttttcatacttctattacattttgggcatttaccactaaccagaccaaacaaccttggtaaggctgagatcttattaatacacttttacaggtaaaatattgacacttataaattttgttctttgacagaacaatatatggtactatatagatctactttattaagtagactaattataactcagttctcctatgtgccttatgatataacttggaagtaagtttgtgaaaaatcaggatatatgtgttgtttgttaaattaactgttttaagcccttttaacacctcactagttttgtactgttttacctcttatttctgaaactctttttatggtgtatcctgttagaggggacaaacatgtcatagaaagcagttgtgcactctttcaaatatagttgataaattcaataatcttatatattgagcttcgtgtttatagtacagtaagtggtctagcaaaattgtccatgtttctttgtttattgataaatgcattgtatagaaactatttcccctaaatatttatggaccaaacaattgtgatatatcctattaaatttgtgtgaataaaacattttgaatctaaggagttttctttcccatcagttttatttaagttttaaccgtactagtgtgttccagcatctatatgtaaaagcttttcaaatggtaatacaacattgttagaaatatttaaacatacaaatagtttttagacttccaaacttctgattcatatgaaatgttacacattgttgcacaggcagtgtaattcaacctagaaatacctttgaatatatttgcttataacaaaagtaatgccccactgatttgactcagtccaatttttagaataaaaaggctaattagcatataaagtaattgcatggaacgaaaccttaaatatgattaagatttcatgttaggtctattgagcacaaatggatatttgtaaatctaaatagaaattgcagacccctaaaagccaagttgctctgtagttaataaattgtcactatgatttttttcagggagaacaaatcttggggcattacagccaaacatcccgacgtttgaaaattccctaaagtattaaaagaaggggaaaagtttgatcggaaatccactgcagtgaagacaaagacactattaggttatgataatcatacattaaaaaatttattaagccaaaaaaaaagagagagagagagacttaaatgtcatttactgaatgttaacgaaacttgtgttctttatggtgtctaacacaactgaaggcctaaaattatgtggtttaaacaaaattagataaaccatgtacaaaaccagagcaacctggcagtaatatgcccaccccatatttgaaaaaaattattattgaaaaaaatttcacacatttgtcaagcacagttgtaaaataaagtccaaaacattcatttcacctgcttgctaatgtgtattagtcctgttaatggcattttccaactgtaaattcaaagaaaagctatcacccatttaagagtatagggatcaaaccccagtaattttagcattattgtttatcacttcctttttaaacagaaatctctgcatgcacttttacatatgtcacctctagtgtacacctctgtatgatgacttatctttgctgtttcttgtatgataaatagctttcattaataaacatttatttgatgcaaacatagttaactttatgttaaacacatgctgttgaaattaattttgaacacttaaagaggcagcacagtacatttacaacttgttatactaatgaaaaaatacaaacagcatagtgagattaaattctggtaatctaggataaaattacttacttggtttttaccttttcatgacttattttcatttgttgtattcaattgccacatgtattaaaaataaaaaacaaagtgaacccaaattacaacaaaataaaccttagaataaactattgtgtaaaatttcagcaacttttttagattactagggtaaaatttatagatcctatgtgagtttacatgtttgctatgcaatgaacaaatttattgatgtatacaaatatattctgaactataaaaagatccaatctttgcatagttcaattacatatgattattacaaacaaaaaagcaaatggaaagacagacaaatatttaggaatgaggttttttttaattgttaaagggaatatttgaagaataaaattttagctattcctatttagccgtatatccaaagcatatgttaaacaaactaacatatactttccagaaaatttttcattatgatgaaatttttattatatacaaatgaaccctatgtaaatgatgtaacttttatgaatgacagacattaaatatttcacttacatgtattctcagaattttgaatgttttcttaaatgctttcacttcctgaataataaaaagaaaaaattttaaagaagagagagcaacttactaataaaaaaaagcaatgcaccatgacaagtagactattttgagtgatcacaaatcatgctggttttgtcagtaacttgaatgtttatgcctcattgaaacctcatccacagctatagcaacttaaatagattttccaatgcatttccagccagtttattcaaatctttgccctacagtcttgccttctttccctgttctgtcacctgtggcaatttcatttagaagtattttggaacttcgcctggttttacagacctttaaatatttgtctggtatgtgaaatgcaggaagagaccagagagggaaagaacataactgaaattagacatctgaaaaaaaaatacaaatttgaaacaggcacattttttaaaaccaaaaaaaaaaaaaaaaagagagagagagagaaaggagtactaattatgtgagtgggaagaggaagcgtgtgatgcagagctggaaggtctgttgtgctttactgtgatgtaaagcagtctttgagtctgggcaactgcacatttactgtttggtgtggaatagaaaaatgtggacctcttagttgagagcaggacactaaattttcatagcttctacctcccagttgcctgggttagtctaacttctggcagattgatcttgggcaaaaagcttcactgagagttagtgtctgtgtgctttggttgaatagccaccttaatactgacttacatagtgggtaggtttttgatacctcaaataaggataaaactccataataaaggacccaaagcaaatacttttaaaacttaggtgatttttcatcacctaaaacataaatagctttatttagcaaaatcccagtggaatctaccacacattcttttataataacccttttttgggagtcaaagtattgtttttttattagccacatataaatatcatctcattttctgttgcagtgtgactgcaaggcatgttgtggtggaaatcattagaactgggaagctctggaatggaaatttggaatcgtgtcattctaggctcttaaagagaatattagggataatactgttgtaaaaaataaatataaacacctaattttgtatgaagttttgctatttaaattttaactatgttataaacaaagctagctttacttgtagagagttcgtgtactcttgagctcattcaatagcttttacattttgtagtctcttccacaacagggcaaaataagcacagtaggacttagtccaaattgacgaaatatcattgaattttctttgaaagcatatatatagataaactctggattggtcttttagatctgttttctgtttttagtaattgggaacaaactcttgatattaaaataaataaaatgcctctaatgtaaagccacagccctgcttctagccaatgtcaaaaataggaagtttttttaatggtttactgttgattttaaacattttaataatagtgctctgccctcacaacagtttttttttcagaataatattatgatttaccttattttaaaaataaattataattctaacttaaaatattattttaaatgcccctctgggaagatttccgttttattttatgaggttccctggcagttgggggggtggtgaggttgggagagggaaagtttagaactgtgcatgatactcaaggaaaagtctatgaatatgatgtaagtagtaacattattgccacaactaaatttctgtttaactgtgttgcagaatatgataatgtcatctaacatcactccctacttgcaacattcctctgtgaatattaatatagttaaccctcccttattatgtatcatatcaataagtttctcttcccttggattaatttttgcttctttgcattacattttatcttgtgctaagataacaaaaagcaagcaagaataaagatccagatattagccatatgtagaaagttcctggtgtgcatttctgtgtacttttccctcacatattagaattgtcaggaaagtttttttcttttggaactttctgtttacattttgcatgatcttataaattaacctgaagagtaattggataccttttatggttatttgaaaataaaatttgctacaaataaga

SEQ ID NO: 16323 - DNA, 3350 bp, Homo sapiens
ctcttttgcttctgcagacattcccggcactggccgactggcgggaggacctccccgcgcgccccgcacaccggctcctgcgcgcaccccaacagagcgcagcgccaggagtccagaagcgggcgggacgccctccgggtcccttacagtgccccttctcgacctggggcaggtcctcccggcccggcccgaacatgctggacggcctaaagatggaggagaacttccaaagcgcgatcgacacctcggcctccttctcctcgctgctgggcagagcggtgagccccaagtctgtctgcgagggctgtcagcgggtcatcttggacaggtttctgctgcggctcaacgacagcttctggcatgagcagtgcgtgcagtgcgcctcctgcaaagagcccctggagaccacctgcttctaccgggacaagaagctgtactgcaagtatgactacgagaagctgtttgctgttaaatgtgggggctgcttcgaggccatcgctcccaatgagtttgttatgcgggcccagaagagtgtataccacctgagctgcttctgctgctgtgtctgcgagcgacagcttcagaagggtgatgagtttgtcctgaaggaggggcagctgctctgcaaaggggactatgagaaggagcgggagctgctcagcctggtgagcccagcagcctcagactcaggtaaaagtgatgatgaagaaagtctctgcaagtcagcccatggggcagggaaaggaactgctgaggaaggcaaggaccataagcgccccaaacgtccgagaaccatcttgacaactcaacagaggcgagcattcaaggcctcatttgaagtatcctccaagccctgcaggaaggtgagagagactctggctgcagagacagggctgagtgtccgtgtcgtccaggtgtggttccaaaaccagagagcgaagatgaagaagctggccaggcgacagcagcagcagcagcaagatcagcagaacacccagaggctgagctctgctcagacaaacggtggtgggagtgctgggatggaaggaatcatgaacccctacacggctctgcccaccccacagcagctcctggccatcgagcagagtgtctacagctcagatcccttccgacagggtctcaccccaccccagatgcctggagaccacatgcacccttatggtgccgagccccttttccatgacctggatagcgacgacacctccctcagtaacctgggtgattgtttcctagcaacctcagaagctgggcctctgcagtccagagtgggaaaccccattgaccatctgtactccatgcagaattcttacttcacatcttgagtcttcccctagagttctgtgactaggctcccatatggaacaaccatattctttgaggggtcactggctttaggacagggaggccagggaagaggtgggttggggagggagttttgttggggatgctgttgtataatgatatggtgtagctcagcatttccaaagactgaatacattatggattgcatagtttaatgtttctaataagagtcttagcattagatatgaagacgtgtttatcattaaggacagagacttttaatatagacattctcatgcaaactagatacttagggactcctaacaacttcccaccatgtcggggaagctcttgtcaagaggtgcatatgtctatccatctacacaccaatagacagaaggacagatagatagatgtgtgtgtgtgagtgtgtaacctttcgtattttaccctcaaagtttattcctaattataacagacaccaactgtacagcaaaagtaactttattttcagtgtgaactatatttaaggaaatgcttgatgcacttaagttataaaatgagataatttacttttataaactttatttttagcttgacaagacttgtcagcagggcagagagggctgctccacctagccccatagctttgagtgctggggttcattctgttttcagagtgtctttcagatctggaaagaaattctgtgtggctgatggtgttctctcttgcattcttgctctctttggggttgaatcactgggcaggggtgggacagaataatctctgatcatgttctgagaaaatgtaaagcccagactcctgggctttcttttaaattctgacaagtggttgttgggcagtgctaggatgattggttcagctcttgagcttcagcatctgcaaatgtggatgaggctaatagtatgtacctacctcactgggaaacaccaaggcttaattcattcccaggacacatgagcagggctgagactaatatctgatatttgtttaagatacaaccaggccactcacttggcaaaggagggtacatagggttgcagagcaggagggctcctgaactccagagggcagttctgcctgctgaagtccctctgcaaagcctgtgctgaaggagacaccagctcagagcagttcagagggatcccagagtcccagagtggggaggaggtgaaggctgaggggatagaggagggcctggtggtgttctagagcagggttgggcaaactcctgcttgcgggcctgctttctatggcttgccagcaaagaatggtttttactttttttttgaggtcattaaaaaaaaggagaagaagaatatataacaggctgtctgtggcctggaaagcctgaaatatttgctatctgtattgtctggcccttacagaaaaagtttggggccccttgttttagagggtctgtttctaaagaacctcatggcgctcatagaggcagaaggttccagtggaaacccttggctcttccttccaactcactcctctgatcctcggcacagaagacccagcagccattgtacatggggacagttccacaccctggtctccagttgcggtgctaggatggtattgttctgtgctaggaagtctcctgggaacccagaatgagttggtggggaagacagcgggtcactgtggacccatccaggaggggccaggataggcttggcctcatttctggggacatcattggagacttgaacacagagacacgtccctatcactctggcaaggccagagggaacatgtccccttatggtagagtctatgttgtgtgatttttgtgctcttgtttataatttatgcaaaccaccaagaaacccaaaccagtctgatgagtgaaaattatgcagatgctgtatggccccacaggtttctgtggtaaagaccagttggagaatgtaggagatactatgtgagtgaaaatgaatagagatccttattccactccttaatggcataccaagatgaaattaaaatctcttac

SEQ ID NO: 16324 - DNA, 3545 bp, Homo sapiens
agaagctgcaggatccgccccggcgaagcagggccgactcgcacccaggaccctgggcctctgccttccctcctagccttggagaagcaactggccctctcctcccgctgaggagcgacgcgggctggtaggacgtcccgggaaggccggcagctcgcgaccacgtcccggcccagcctgggcgcgccgaggagcagagccagcggccggcgttcgctccggctccctccccggcgctccgaagccgagggcggctcctccggctgcagtctcgggggcgacgccttcccgggcagaagcttccagcagcgctccgcaacttctctctgctccagtcactgggagagagctcgcctaccaggtcctcccggcccggcccgaacatgctggacggcctaaagatggaggagaacttccaaagcgcgatcgacacctcggcctccttctcctcgctgctgggcagagcggtgagccccaagtctgtctgcgagggctgtcagcgggtcatcttggacaggtttctgctgcggctcaacgacagcttctggcatgagcagtgcgtgcagtgcgcctcctgcaaagagcccctggagaccacctgcttctaccgggacaagaagctgtactgcaagtatgactacgagaagctgtttgctgttaaatgtgggggctgcttcgaggccatcgctcccaatgagtttgttatgcgggcccagaagagtgtataccacctgagctgcttctgctgctgtgtctgcgagcgacagcttcagaagggtgatgagtttgtcctgaaggaggggcagctgctctgcaaaggggactatgagaaggagcgggagctgctcagcctggtgagcccagcagcctcagactcaggtaaaagtgatgatgaagaaagtctctgcaagtcagcccatggggcagggaaaggaactgctgaggaaggcaaggaccataagcgccccaaacgtccgagaaccatcttgacaactcaacagaggcgagcattcaaggcctcatttgaagtatcctccaagccctgcaggaaggtgagagagactctggctgcagagacagggctgagtgtccgtgtcgtccaggtgtggttccaaaaccagagagcgaagatgaagaagctggccaggcgacagcagcagcagcagcaagatcagcagaacacccagaggctgagctctgctcagacaaacggtggtgggagtgctgggatggaaggaatcatgaacccctacacggctctgcccaccccacagcagctcctggccatcgagcagagtgtctacagctcagatcccttccgacagggtctcaccccaccccagatgcctggagaccacatgcacccttatggtgccgagccccttttccatgacctggatagcgacgacacctccctcagtaacctgggtgattgtttcctagcaacctcagaagctgggcctctgcagtccagagtgggaaaccccattgaccatctgtactccatgcagaattcttacttcacatcttgagtcttcccctagagttctgtgactaggctcccatatggaacaaccatattctttgaggggtcactggctttaggacagggaggccagggaagaggtgggttggggagggagttttgttggggatgctgttgtataatgatatggtgtagctcagcatttccaaagactgaatacattatggattgcatagtttaatgtttctaataagagtcttagcattagatatgaagacgtgtttatcattaaggacagagacttttaatatagacattctcatgcaaactagatacttagggactcctaacaacttcccaccatgtcggggaagctcttgtcaagaggtgcatatgtctatccatctacacaccaatagacagaaggacagatagatagatgtgtgtgtgtgagtgtgtaacctttcgtattttaccctcaaagtttattcctaattataacagacaccaactgtacagcaaaagtaactttattttcagtgtgaactatatttaaggaaatgcttgatgcacttaagttataaaatgagataatttacttttataaactttatttttagcttgacaagacttgtcagcagggcagagagggctgctccacctagccccatagctttgagtgctggggttcattctgttttcagagtgtctttcagatctggaaagaaattctgtgtggctgatggtgttctctcttgcattcttgctctctttggggttgaatcactgggcaggggtgggacagaataatctctgatcatgttctgagaaaatgtaaagcccagactcctgggctttcttttaaattctgacaagtggttgttgggcagtgctaggatgattggttcagctcttgagcttcagcatctgcaaatgtggatgaggctaatagtatgtacctacctcactgggaaacaccaaggcttaattcattcccaggacacatgagcagggctgagactaatatctgatatttgtttaagatacaaccaggccactcacttggcaaaggagggtacatagggttgcagagcaggagggctcctgaactccagagggcagttctgcctgctgaagtccctctgcaaagcctgtgctgaaggagacaccagctcagagcagttcagagggatcccagagtcccagagtggggaggaggtgaaggctgaggggatagaggagggcctggtggtgttctagagcagggttgggcaaactcctgcttgcgggcctgctttctatggcttgccagcaaagaatggtttttactttttttttgaggtcattaaaaaaaaggagaagaagaatatataacaggctgtctgtggcctggaaagcctgaaatatttgctatctgtattgtctggcccttacagaaaaagtttggggccccttgttttagagggtctgtttctaaagaacctcatggcgctcatagaggcagaaggttccagtggaaacccttggctcttccttccaactcactcctctgatcctcggcacagaagacccagcagccattgtacatggggacagttccacaccctggtctccagttgcggtgctaggatggtattgttctgtgctaggaagtctcctgggaacccagaatgagttggtggggaagacagcgggtcactgtggacccatccaggaggggccaggataggcttggcctcatttctggggacatcattggagacttgaacacagagacacgtccctatcactctggcaaggccagagggaacatgtccccttatggtagagtctatgttgtgtgatttttgtgctcttgtttataatttatgcaaaccaccaagaaacccaaaccagtctgatgagtgaaaattatgcagatgctgtatggccccacaggtttctgtggtaaagaccagttggagaatgtaggagatactatgtgagtgaaaatgaatagagatccttattccactccttaatggcataccaagatgaaattaaaatctcttacaaatga

SEQ ID NO: 16325 - DNA, 1342 bp, Homo sapiens
ctgatctctcctcccaccctacattctcttggctggaccctatcctcctggctgattctggtcgccctggacactccctcagttctttcccaggagtgcggtggctgctggcgccgagtcccagcgggcacggacgtcagacgcatcgtttcttctcctctacaggtcctcccggcccggcccgaacatgctggacggcctaaagatggaggagaacttccaaagcgcgatcgacacctcggcctccttctcctcgctgctgggcagagcggtgagccccaagtctgtctgcgagggctgtcagcgggtcatcttggacaggtttctgctgcggctcaacgacagcttctggcatgagcagtgcgtgcagtgcgcctcctgcaaagagcccctggagaccacctgcttctaccgggacaagaagctgtactgcaagtatgactacgagaagctgtttgctgttaaatgtgggggctgcttcgaggccatcgctcccaatgagtttgttatgcgggcccagaagagtgtataccacctgagctgcttctgctgctgtgtctgcgagcgacagcttcagaagggtgatgagtttgtcctgaaggaggggcagctgctctgcaaaggggactatgagaaggagcgggagctgctcagcctggtgagcccagcagcctcagactcaggtaaaagtgatgatgaagaaagtctctgcaagtcagcccatggggcagggaaaggaactgctgaggaaggcaaggaccataagcgccccaaacgtccgagaaccatcttgacaactcaacagaggcgagcattcaaggcctcatttgaagtatcctccaagccctgcaggaaggtgagagagactctggctgcagagacagggctgagtgtccgtgtcgtccaggtgtggttccaaaaccagagagcgaagatgaagaagctggccaggcgacagcagcagcagcagcaagatcagcagaacacccagaggctgagctctgctcagacaaacggtggtgggagtgctgggatggaaggaatcatgaacccctacacggctctgcccaccccacagcagctcctggccatcgagcagagtgtctacagctcagatcccttccgacagggtctcaccccaccccagatgcctggagaccacatgcacccttatggtgccgagccccttttccatgacctggatagcgacgacacctccctcagtaacctgggtgattgtttcctagcaacctcagaagctgggcctctgcagtccagagtgggaaaccccattgaccatctgtactccatgcagaattcttacttcacatcttgagtcttc

SEQ ID NO: 16326 - DNA, 5809 bp, Homo sapiens
gcgtcccatggatatagcaacaggtcccgagtcgctggagaggtgcttccctcgcgggcagacggactgcgccaagatgttggacggcatcaagatggaggagcacgccctgcgccccgggcccgccactctgggggtgctgctgggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagctcttcgcggccaagtgcagcggctgcatggagaagatcgcccccaccgagttcgtgatgcgggcgctggagtgcgtgtaccacctgggctgcttctgctgctgcgtgtgtgaacggcagctacgcaagggcgacgaattcgtgctcaaggagggccagctgctgtgcaagggtgactacgagaaggagaaggacctgctcagctccgtgagccccgacgagtccgactccgtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcgaagccttgccgaaaggtccgagagacactggcagctgagacgggcctcagtgtgcgcgtggtccaggtctggtttcagaaccaaagagcaaagatgaagaagctggcgcggcggcaccagcagcagcaggagcagcagaactcccagcggctgggccagggtgagccggggccggggcagggcctgggccaggaggtcctgtccagccgcatggagggcatgatggcttcctacacgccgctggccccaccacagcagcagatcgtggccatggaacagagcccctacggcagcagcgaccccttccagcagggcctcacgccgccccaaatgccagggaacgactccatcttccatgacatcgacagcgatacctccttaaccagcctcagcgactgcttcctcggctcctcagacgtgggctccctgcaggcccgcgtggggaaccccatcgaccggctctactccatgcagagttcctacttcgcctcctgagagccagccaggcgcacggacgcttgggcaggggcctgggggggactgccagcctctgcggccagcctggccacccccgccctgctctccgcacagactacagacagccatacggtgccctcccctcggccagctgggcctgaccactgtgcccgttgggtacagccagaccggtagatgggcacagcctgggcaggggctgtgtcctgcccacagagaccttgtcatccccagggacccagagctctcggacggccactcgcctcccagccccacctcggcctccatcgcctcctccccatctcttttttgggaagcttaaattctctctatttttttaaatgtcctctctgtgtccatggccctccatgcaagccccaggacaatggtgtcatgaggcggtgacctgagaagcgtgtgtacctgtgccccagcaagggcaggggtggcctctgggggcaggcccactgcctggaaccgcacacccctcagcctgagtctggagcagcagtggagaggggcctgaggggaggcactgtcaggaggcgggctcggagcctgagcctgggcaggcgcaaagggacagagaggcacgtgcagacacatgcacacttgcagacaaacccacgcaaacacacacacagctgtatggggacaccagaagggacagggatgctcagcgggtctgtcctgccttgtcagaaagagaaaaggaggccaggcaggggaccccccagttcttaagagcgattggaaagggaggaaggggagaggaagaggcgaacttgaagcatcggacccagttgtatcccagcctgggcccaaatgggggcagcctgggcagggagggcagccccaggccccaccaactctagaggcagatggagcccccagaaccaggtagcatcagaccagacaacagagcctccaggggtcagggacttcagaagcacctgctgggcaccccatctgcaatgtggtcctctccccagccacctctgcctcccctcacatacctccagtgacaaggagctcactaggtcagcgagcccacagcagctgtgctgtcctgcatcccagagccaggcttccccagctctccctcttaacactgtcccccagcaggcctccggctgtccctctaaaggtgtggggcaggtatcacttcaccttcccactgatgtcagccggccagaagtgagcaggcacatcacctctcctgctgtggcacccttcctctgttaatttggcccaaaagacaatgatttggccacatgaccttagagattcaccctgccctgctgtagctaaatccctgggccccacacgcaagtgacagctaagccacatctgttttctgtgtatatgcaggatgggggcacctactgttttgttttgttttgttttgttttgttttgttttgttttgttttgttttgtttgagacggagtttcgctcttgttgcccaggctggagtgcaatggcgcgatctcggctcaccacaacctccgcctcccaggttcaagtgattctgatgcctcagcctccctagtagctgagattacaggcatgcgccaccacacccagctaattttgtatttttagtagcaacggggtttctccatgttggtcaggctggtctccaacccccgacctcaggtgatccgcctgcctcggcctcccaaagtgctgggattacaggcgtgagccaccgcacccagtctgcacttactgtttagactgaatgagggaccgtgacctctttccttttccattccttcttactcgattcattccagcctgtggaatttctctgcaccctgattcagtgaccactgctctcctctctcccagcacatctgcccagtgaggagttggccctgggtctcacctgaggtgtgtggaccgggctggcctctccctgtttgacattggcccattaatgcatcctctttgggggacacattccaattgcatttcctgcccccttctcccagggcaattgcagaagattgtgtcaggcgccctgctggaagtcaggtgcactagatccatccccagccccagtctgctcaactctatccctgtcagagcaaggaggctgggctgctggggcctgactggtgagcccaccctgtcccctggtgatcactgtgtccccttgttcaggtgctcacaaccctacctttaactctgaggtcaagccctaggccaccaccctaaagtctgcctggtccaacctttgagcaagtaaggataatgaatgtcccttttccacctttggggccctctgcctggatctctggaatcctctaagttcaacctgttctgtggttttgctcccgtttgctgggaaattcagtccccccagaatgtcctgggccaacctccttgcctgacatgtggcctcgtgtcacccattgggccccagcagccagctagcccttctgcagctcttcttacaaacagagcctctccaaggacctcagttgatgttctggtccttctgccgcctcagcccaccagggtccgtgccaccatgggtctcttgagcagcagctgcactggcttctggagagacacccctctttctccttttgcacatgcaccatctgaatcgtgccagggacatcctgggcagattcaggggcagatgccctatcccccaggagacctggcccttctctctcagacccaataagttggaagggacgtcagaagcggtcatctcatctgccccttattttatagttggaaaccctgaggcaagagagggaaagaggcctgtccaaggtccgggttagtgacagagctgagctgagaacagggacgttgtgccccactgtcccctgtggtttgtgaatgacctccaggtcagggggtcacaacttgttcttagtaaacttgccagctgttggggtcacatattcccattctggggcctcacaaacccccgaatccagccgggaccccatgccaggagctggtctagggacagcatgcttgtgacccacagactgttaaagccagaagggacctcagagagtcccttatgctggaggcgccctgtcagccgtggctaggggccccttgctctatgctgtgccttgctgcccacaggctcccagacaccagtgcccactctgcccagccccggactgggtgtggctcgcagatgaacaagatgcagggcctgccttgaggggtgtctcctagaaggaaagccagactctccggcccagccagagagtccagacatggcagggacccgtttctcagatgaggagcctgaggctcagagaagggaggcgatgtgttcagggccacccagcagaagcctgtggggctgggcaaccttctcccactttatgggaggagctgcagccttggctgggagctgggcggggagtagccaggaccaccccttgcccgtgccgtgacatggaaccttcatcactaagggggctggagtgggaagagggagataactgtgtggtctccagagcaaaagagaatgagaggtgggcagggggagtcttggcaaaagaccaagttccacttccctgctggggaagtcaaggctcagaaagaggaaataattgccccaggtaacacagggcagaggagggacaaaaagctgggcatggccccagccagagcctcatctgcctactccgtgaagcctcccaggtactctgctatcctgggaaacgcacagggaggccacacagagacactgctcacaagagtcagaccaaggtgccagcacagcctggaaagagctcagaaagggggttggtgcacgtggctgggcatcttaggaggcttcctgagggtgggtaaaggtgggaaggccctggcgctgcatcagatgagcagggcctggcagggacaagcctcttctcctttgggaagccctgcagcctcctagcaagaggctgattccccactctgcccccatctgaatgtccttttcatgttgcacgcagggaacctcaggaaggaggattgcctgatgcctgcctggctccatccttgagctctgggcaccacctagggtgagggagagcctgcagctctggggctaagtctgccctggggggaaagggctccacgctcacacgcacgcgctcgcacacacacactcacacctggacgcacacggaggcttgcggacccatactcacaggcacatgtggcctggggactgggggagcaggaaagacccctccaacatttggcccttggaaggcaccattgccaatgagcctctttgctggttcccccgaccccacctgggggtcccatgggagcccagcccagccaggtgtggggatgggccaccggccattcctgttttccttgtacagacagattctcactacccacccgccatccccagacacattttatttaataacttgtcattgttaaattatttattagcgtttaccacaccaccacccccaccctgccctccactctcaccttccacctcttcccacaacagcagaaaatggaaacaacaacaaaaaaagatgagacatcagtatatttgtaaataaaccgacctgtacactc

SEQ ID NO: 16327 - DNA, 1522 bp, Homo sapiens
gcgtcccatggatatagcaacaggtcccgagtcgctggagaggtgcttccctcgcgggcagacggactgcgccaagatgttggacggcatcaagatggaggagcacgccctgcgccccgggcccgccactctgggggtgctgctgggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagctcttcgcggccaagtgcagcggctgcatggagaagatcgcccccaccgagttcgtgatgcgggcgctggagtgcgtgtaccacctgggctgcttctgctgctgcgtgtgtgaacggcagctacgcaagggcgacgaattcgtgctcaaggagggccagctgctgtgcaagggtgactacgagaaggagaaggacctgctcagctccgtgagccccgacgagtccgactccgtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcgaagccttgccgaaaggtccgagagacactggcagctgagacgggcctcagtgtgcgcgtggtccaggtctggtttcagaaccaaagagcaaagatgaagaagctggcgcggcggcaccagcagcagcaggagcagcagaactcccagcggctgggccaggaggtcctgtccagccgcatggagggcatgatggcttcctacacgccgctggccccaccacagcagcagatcgtggccatggaacagagcccctacggcagcagcgaccccttccagcagggcctcacgccgccccaaatgccaggtgaccacatgaacccctatgggaacgactccatcttccatgacatcgacagcgatacctccttaaccagcctcagcgactgcttcctcggctcctcagacgtgggctccctgcaggcccgcgtggggaaccccatcgaccggctctactccatgcagagttcctacttcgcctcctgagagccagccaggcgcacggacgcttgggcaggggcctgggggggactgccagcctctgcggccagcctggccacccccgccctgctctccgcacagactacagacagccatacggtgccctcccctcggccagctgggcctgaccactgtgcccgttgggtacagccagaccggtagatgggcacagcctgggcaggggctgtgtcctgcccacagagaccttgtcatccccagggacccagagctctcggacggccactcgcctcccagccccacctcggcctccatcgcctcctccccatctct

SEQ ID NO: 16328 - DNA, 5776 bp, Homo sapiens
gcgtcccatggatatagcaacaggtcccgagtcgctggagaggtgcttccctcgcgggcagacggactgcgccaagatgttggacggcatcaagatggaggagcacgccctgcgccccgggcccgccactctgggggtgctgctgggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagctcttcgcggccaagtgcagcggctgcatggagaagatcgcccccaccgagttcgtgatgcgggcgctggagtgcgtgtaccacctgggctgcttctgctgctgcgtgtgtgaacggcagctacgcaagggcgacgaattcgtgctcaaggagggccagctgctgtgcaagggtgactacgagaaggagaaggacctgctcagctccgtgagccccgacgagtccgactccgtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcgaagccttgccgaaaggtccgagagacactggcagctgagacgggcctcagtgtgcgcgtggtccaggtctggtttcagaaccaaagagcaaagatgaagaagctggcgcggcggcaccagcagcagcaggagcagcagaactcccagcggctgggccaggaggtcctgtccagccgcatggagggcatgatggcttcctacacgccgctggccccaccacagcagcagatcgtggccatggaacagagcccctacggcagcagcgaccccttccagcagggcctcacgccgccccaaatgccagggaacgactccatcttccatgacatcgacagcgatacctccttaaccagcctcagcgactgcttcctcggctcctcagacgtgggctccctgcaggcccgcgtggggaaccccatcgaccggctctactccatgcagagttcctacttcgcctcctgagagccagccaggcgcacggacgcttgggcaggggcctgggggggactgccagcctctgcggccagcctggccacccccgccctgctctccgcacagactacagacagccatacggtgccctcccctcggccagctgggcctgaccactgtgcccgttgggtacagccagaccggtagatgggcacagcctgggcaggggctgtgtcctgcccacagagaccttgtcatccccagggacccagagctctcggacggccactcgcctcccagccccacctcggcctccatcgcctcctccccatctcttttttgggaagcttaaattctctctatttttttaaatgtcctctctgtgtccatggccctccatgcaagccccaggacaatggtgtcatgaggcggtgacctgagaagcgtgtgtacctgtgccccagcaagggcaggggtggcctctgggggcaggcccactgcctggaaccgcacacccctcagcctgagtctggagcagcagtggagaggggcctgaggggaggcactgtcaggaggcgggctcggagcctgagcctgggcaggcgcaaagggacagagaggcacgtgcagacacatgcacacttgcagacaaacccacgcaaacacacacacagctgtatggggacaccagaagggacagggatgctcagcgggtctgtcctgccttgtcagaaagagaaaaggaggccaggcaggggaccccccagttcttaagagcgattggaaagggaggaaggggagaggaagaggcgaacttgaagcatcggacccagttgtatcccagcctgggcccaaatgggggcagcctgggcagggagggcagccccaggccccaccaactctagaggcagatggagcccccagaaccaggtagcatcagaccagacaacagagcctccaggggtcagggacttcagaagcacctgctgggcaccccatctgcaatgtggtcctctccccagccacctctgcctcccctcacatacctccagtgacaaggagctcactaggtcagcgagcccacagcagctgtgctgtcctgcatcccagagccaggcttccccagctctccctcttaacactgtcccccagcaggcctccggctgtccctctaaaggtgtggggcaggtatcacttcaccttcccactgatgtcagccggccagaagtgagcaggcacatcacctctcctgctgtggcacccttcctctgttaatttggcccaaaagacaatgatttggccacatgaccttagagattcaccctgccctgctgtagctaaatccctgggccccacacgcaagtgacagctaagccacatctgttttctgtgtatatgcaggatgggggcacctactgttttgttttgttttgttttgttttgttttgttttgttttgttttgttttgtttgagacggagtttcgctcttgttgcccaggctggagtgcaatggcgcgatctcggctcaccacaacctccgcctcccaggttcaagtgattctgatgcctcagcctccctagtagctgagattacaggcatgcgccaccacacccagctaattttgtatttttagtagcaacggggtttctccatgttggtcaggctggtctccaacccccgacctcaggtgatccgcctgcctcggcctcccaaagtgctgggattacaggcgtgagccaccgcacccagtctgcacttactgtttagactgaatgagggaccgtgacctctttccttttccattccttcttactcgattcattccagcctgtggaatttctctgcaccctgattcagtgaccactgctctcctctctcccagcacatctgcccagtgaggagttggccctgggtctcacctgaggtgtgtggaccgggctggcctctccctgtttgacattggcccattaatgcatcctctttgggggacacattccaattgcatttcctgcccccttctcccagggcaattgcagaagattgtgtcaggcgccctgctggaagtcaggtgcactagatccatccccagccccagtctgctcaactctatccctgtcagagcaaggaggctgggctgctggggcctgactggtgagcccaccctgtcccctggtgatcactgtgtccccttgttcaggtgctcacaaccctacctttaactctgaggtcaagccctaggccaccaccctaaagtctgcctggtccaacctttgagcaagtaaggataatgaatgtcccttttccacctttggggccctctgcctggatctctggaatcctctaagttcaacctgttctgtggttttgctcccgtttgctgggaaattcagtccccccagaatgtcctgggccaacctccttgcctgacatgtggcctcgtgtcacccattgggccccagcagccagctagcccttctgcagctcttcttacaaacagagcctctccaaggacctcagttgatgttctggtccttctgccgcctcagcccaccagggtccgtgccaccatgggtctcttgagcagcagctgcactggcttctggagagacacccctctttctccttttgcacatgcaccatctgaatcgtgccagggacatcctgggcagattcaggggcagatgccctatcccccaggagacctggcccttctctctcagacccaataagttggaagggacgtcagaagcggtcatctcatctgccccttattttatagttggaaaccctgaggcaagagagggaaagaggcctgtccaaggtccgggttagtgacagagctgagctgagaacagggacgttgtgccccactgtcccctgtggtttgtgaatgacctccaggtcagggggtcacaacttgttcttagtaaacttgccagctgttggggtcacatattcccattctggggcctcacaaacccccgaatccagccgggaccccatgccaggagctggtctagggacagcatgcttgtgacccacagactgttaaagccagaagggacctcagagagtcccttatgctggaggcgccctgtcagccgtggctaggggccccttgctctatgctgtgccttgctgcccacaggctcccagacaccagtgcccactctgcccagccccggactgggtgtggctcgcagatgaacaagatgcagggcctgccttgaggggtgtctcctagaaggaaagccagactctccggcccagccagagagtccagacatggcagggacccgtttctcagatgaggagcctgaggctcagagaagggaggcgatgtgttcagggccacccagcagaagcctgtggggctgggcaaccttctcccactttatgggaggagctgcagccttggctgggagctgggcggggagtagccaggaccaccccttgcccgtgccgtgacatggaaccttcatcactaagggggctggagtgggaagagggagataactgtgtggtctccagagcaaaagagaatgagaggtgggcagggggagtcttggcaaaagaccaagttccacttccctgctggggaagtcaaggctcagaaagaggaaataattgccccaggtaacacagggcagaggagggacaaaaagctgggcatggccccagccagagcctcatctgcctactccgtgaagcctcccaggtactctgctatcctgggaaacgcacagggaggccacacagagacactgctcacaagagtcagaccaaggtgccagcacagcctggaaagagctcagaaagggggttggtgcacgtggctgggcatcttaggaggcttcctgagggtgggtaaaggtgggaaggccctggcgctgcatcagatgagcagggcctggcagggacaagcctcttctcctttgggaagccctgcagcctcctagcaagaggctgattccccactctgcccccatctgaatgtccttttcatgttgcacgcagggaacctcaggaaggaggattgcctgatgcctgcctggctccatccttgagctctgggcaccacctagggtgagggagagcctgcagctctggggctaagtctgccctggggggaaagggctccacgctcacacgcacgcgctcgcacacacacactcacacctggacgcacacggaggcttgcggacccatactcacaggcacatgtggcctggggactgggggagcaggaaagacccctccaacatttggcccttggaaggcaccattgccaatgagcctctttgctggttcccccgaccccacctgggggtcccatgggagcccagcccagccaggtgtggggatgggccaccggccattcctgttttccttgtacagacagattctcactacccacccgccatccccagacacattttatttaataacttgtcattgttaaattatttattagcgtttaccacaccaccacccccaccctgccctccactctcaccttccacctcttcccacaacagcagaaaatggaaacaacaacaaaaaaagatgagacatcagtatatttgtaaataaaccgacctgtacactc

SEQ ID NO: 16329 - DNA, 1195 bp, Homo sapiens
gcgtcccatggatatagcaacaggtcccgagtcgctggagaggtgcttccctcgcgggcagacggactgcgccaagatgttggacggcatcaagatggaggagcacgccctgcgccccgggcccgccactctgggggtgctgctgggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagctcttcgcggccaagtgcagcggctgcatggagaagatcgcccccaccgagttcgtgatgcgggcgctggagtgcgtgtaccacctgggctgcttctgctgctgcgtgtgtgaacggcagctacgcaagggcgacgaattcgtgctcaaggagggccagctgctgtgcaagggtgactacgagaaggagaaggacctgctcagctccgtgagccccgacgagtccgactccgtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcgaagccttgccgaaaggtccgagagacactggcagctgagacgggcctcagtgtgcgcgtggtccaggtctggtttcagaaccaaagagcaaagatgaagaagctggcgcggcggcaccagcagcagcaggagcagcagaactcccagcggctgggccaggaggtcctgtccagccgcatggagggcatgatggcttcctacacgccgctggccccaccacagcagcagatcgtggccatggaacagagcccctacggcagcagcgaccccttccagcagggcctcacgccgccccaaatgccagggaacgactccatcttccatgacatcgacagcgatacctccttaaccagcctcagcgactgcttcctcggctcctcagacgtgggctccctgcaggcccgcgtggggaaccccatcgaccggctctactccatgcagagttcctacttcgcctcctga

SEQ ID NO: 16330 - DNA, 2933 bp, Homo sapiens
ggggctgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaagagagtgagccgcaattgttctgaaaatgtcaaacgaggcttctgttttgcacctgcagatcaccgagttggttttcttttcttttcttgcctttttttttttttgaaatttgccgagcagtggagccctctgacaatttgcaaggccctctgagaaaggaagctgcttagagccagggggttagtgggtgaggggagcgagtgctgtttttgagatcattatctgaactcaggcagcctagtagaggcagtggtgggattccaatgggtcttggtgggtgggaggtggggcatgtgcaaagcaagcaaggaacatttggggtaagaaaacaaacatgaggcaaaagaaaaaatacatgtttttaagaaaacattgagcagagaactgcagccaggatgcgctcagcagacattcactctggctgctgggacatcagaaaacaaagtcttcatctctctctccagtttcacccaccccaccctttgctttcatttcaggtgtgttggtctatatgacagggaggagagtaaaggagagcaggagcaattggctgcctgcaaagccagctggaggtgaagtgcaggaaaggaaaggtcaccccattctactccatggcctctctgctcccagctgtggtaggctcacatagccagtgtgatcggtttttaagaggcagtgcttttcagcttttctccctgatatatccattttgcttcccagcactttttaggagtagtgagagcacttcctgcccttgttggaagccccagggtggacactcagcacgaaggtctctcccttaactgctgcccttccaagacttgctcccgagatggagtgggcgtggtcttccaggctggcccttccttctcctcaccgccaccttccctgccccagccccagcagccatgggtacatgggtccccagctcacctatggattcccgccagtctgcccagctgcagtactcacgccccatgggggatcttggtctgtttttcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgtccttactcaacagtggtcctcatccctccccacctcccactgcttcctgcaagggcaccagttgtatgagaaagttggcctttggacttaggatttcttattgtagctaagagccatctgaagcagcaggttgcaggacaaatgcttcagtccgccgagagcagtaccgtgtggccaagaggtggactcagagccttccttgagctaaactcggccaaccaaggcacgcagcatgtcccctcaggtctccagtcagtccaggttgaccctcagttctggacgtgtgtatatagctgtatttaatacctcaaggtcattgtggctctggggatgccggggcaggaggacgagggtgcgctgtggacacagcagtccgcggaattccgttctgggaagccaatggtcgccggcaccccttgcttcctccctctgttgtctgcctgtgtgacacacatcaatggcaataacttcttccaactcctcgcagaagtgggagaggccggcagcctgcaccgagaggggctttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgtcctggtcttgctgtgtgatgggaacatgcttgtaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctttcca

SEQ ID NO: 16331 - DNA, 1363 bp, Homo sapiens
ggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactggggcttcataaacttcacttaccaaatacttcaagggattcagaaacagcctcagtgatgacctcgtctgccagggacacaggttttcatcatttacaggctcttatgtgctag

SEQ ID NO: 16332 - DNA, 841 bp, Homo sapiens
gccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttcacttaccaaatacttcaagggattcagaaacagccaagccttctgtaaatgggcatcagaaagcactgtga

SEQ ID NO: 16333 - DNA, 4911 bp, Homo sapiens
gccccgcccccgccccgcccccgactgcgcggcgcccgccctcccttagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttc

SEQ ID NO: 16334 - DNA, 2888 bp, Homo sapiens
gccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgtgggaatgctttgtgcgggaaatccagaagttgcaacaggaagacaagtgccagaagaacaagctggacagctacttttgggaaaatggattcaggagggaggagacatgatagcaaacccacggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgc

SEQ ID NO: 16335 - DNA, 3628 bp, Homo sapiens
ggtttgtggaatcttgcttcccttttttccaacctttgtttatttgtattgatgccctttgcctttttctttctggaatcagaaggctttgctggcctgaaaaaggagggcaagatgtccaggcaaaaccttgtttaaatgttcatcaccatagaaacatgacagcttctccatagagcttttggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactggggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattat

SEQ ID NO: 16336 - DNA, 3457 bp, Homo sapiens
gggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgtgggaatgctttgtgcgggaaatccagaagttgcaacaggaagacaagtgccagaagaacaagctggacagctacttttgggaaaatggattcaggagggaggagacatgatagcaaacccacggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttca

SEQ ID NO: 16337 - DNA, 1942 bp, Homo sapiens
agagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactggggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggt

SEQ ID NO: 16338 - DNA, 2349 bp, Homo sapiens
tgtgtcgtcactagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagca

SEQ ID NO: 16339 - DNA, 1956 bp, Homo sapiens
atggttaatgtgaaagccctttgtgaacctgaagtgagcaactgctggatgaatgtcattacgggcacaggctctgtgtcatctcctctcctagtgcttccacagccaggaccagagacctccctgatgactggggaacctgtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaa

SEQ ID NO: 16340 - DNA, 2235 bp, Homo sapiens
ctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgttttttt

SEQ ID NO: 16341 - DNA, 567 bp, Homo sapiens
agatctcttaaaaagatggaccctcagcggcgcttcctcgtagcgagcctagtggcgggtgtttgcattgaaacgctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcct

SEQ ID NO: 16342 - DNA, 1740 bp, Homo sapiens
ggggagagaggctctgggttgctgctgcttctgctgctgctgctgctgtgtggctgtttctgtacactcactggcaggcttggtgccggctccctcgcccgcccgcccgccagcctgggaaagtgggttacagagcgaaggagctcagctcagacactggcagaggagcatccagtcacagagagaccaaacaagaaccctttcctttggcttcctcttcagctcttccagagggcttgctatttgcactctctcttttgaaattgtgttgcttttacttttcacccttctgcttgggttttatgagggctttgttaagtcttagagggaaaagagactgagcgagggaaagagagaggcaaagtggaaaggaccataaactggcaaagcccgctctgcgctcgctgtggatgaaagccccgtgttggtgaagcctctcctcgcgagcagcgcgcacccctccagagcaccccgcggacccgcacctcggcgtggccaccatggtcaggagagttcagccggatcggaaacagttgccactggtcctactgagattgctctgccttcttcccacaggactgcctgttcgcagcgtggattttaaccgaggcacggacaacatcaccgtgaggcagggggacacagccatcctcaggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcagacctgggtcggtgagaggaataaatggatccatcagtctggccgtaccactgtggctgctggcagcatctctgctctgccttctcagcaaatgttaatagaataaaaatttaaaaataatttaaaaaacacacaaaaatgcgtcacacagaatacagagagagagagacagagagagagagagagagagagatgggggagaccgtttatttcacaactttgtgtgtttatacatgaagggggaaataagaaagtgaagaagaaaatacaacatttaaaacaattttacagtccatcattaaaaatttatgtatcattcag

SEQ ID NO: 16343 - DNA, 1077 bp, Homo sapiens
atgaggacctactggctgcacagcgtctgggtgctgggctttttcctgtccctcttctcattgcaaggactgcctgttcgcagcgtggattttaaccgaggcacggacaacatcaccgtgaggcagggggacacagccatcctcaggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcaaacgtgttttacccacaatcccccaccccattcaagaaattggtaccaccgtgcacttcaagcaaaaaggacctgggtcggtgagaggaataaatggatccatcagtctggccgtaccactgtggctgctggcagcatctctgctctgccttctcagcaaatgttaa

SEQ ID NO: 16344 - DNA, 5505 bp, Homo sapiens
aattgacaaagtcacgtgtgctcagggggccagaaactggagagaggagagaaaaaaatcaaaagaaggaaagcacattagaccatgcgagctaaatttgtgatcgcacaaaatcaagatgttagattgatgcagaagatcactccgttccaaagggaaagttttcatctcacgagtttggagctgagggcccgtggggcaacatggccgaaggcggggctagcaaaggtggtggagaagagcccgggaagctgccggagccggcagaggaggaatcccaggttttgcgcggaactggccactgtaagtggttcaatgtgcgcatgggatttggattcatctccatgataaaccgagagggaagccccttggatattccagtcgatgtatttgtacaccaaagcaaactattcatggaaggatttagaagcctaaaagaaggagaaccagtggaattcacatttaaaaaatcttccaaaggccttgagtcaatacgggtaacaggacctggtgggagcccctgtttaggaagtgaaagaagacccaaagggaagacactacagaaaagaaaaccaaagggagatagatgctacaactgtggtggccttgatcatcatgctaaggaatgtagtctacctcctcagccaaagaagtgccattactgtcagagcatcatgcacatggtggcaaactgcccacataaaaatgttgcacagccacccgcgagttctcagggaagacaggaagcagaatcccagccatgcacttcaactctccctcgagaagtgggaggcgggcatggctgtacatcaccaccgtttcctcaggaggctagggcagagatctcagaacggtcaggcaggtcacctcaagaagcttcctccacgaagtcatctatagcaccagaagagcaaagcaaaaaggggccttcagttcaaaaaaggaaaaagacataacaggtcttcttcatatgttctttcctttacccggttgcaaagtctacctcatgcaagtataggggaacagtatttcacaagcagtagctgacctgggattttaactactattggggaactgtgaattttttaaacagacaaatcactctaagcaaattacatttgagcagggtgtcatgttttatgttaattcagagaataagatactatgtctgtcaatatgtgcatgtgtgagagggagagagcctgagtctgtgtgtgtacatgaggatttttatataggaatgtagacacatatataaagaggctttgtctttatatatttgtgtatagatcaaagcacacaccctctctcatataattggatatttccaagaattgaaaacccatgtgaagcattatagatagttttaaatttaacccactggagttttcttgaaataccacttcttttatattatataaaactaaaaacacgactgttaccttttgtgtgaaccaaaggatacttcagatctcagagctgccaattatggggtactaaaggtttttaagacatccagttctcccgaatttgggattgcctctttttcttgaaatctctggagtagtaatttttttcccccttttttgaaggcagtaccttaacttcatatgcctctgactgccataagcttttttgattctgggataacataactccagaaaagacaatgaatgtgtaatttgggccgatatttcactgttttaaattctgtgtttaattgtaaaattagatgcctattaagagaaatgaaggggaggatcatcttagtggcttgttttcagtagtattttaatatcagcttcttgtaaccttttccatgttgtgagggttgtaagggattgtgtggcaacagcagcttcccttggctaactcaatcttctacccattgcttagagcagggagccctccttatttactactgaagaccttagagaactccaattgtttggcatatatttttggtggtggtttttattcctcctggagagttatctaatttgtttctaaaacaaacaagcagcaaagaaatgaattaaatactggggttgagaattaaaattaagtggatgttcacagttgcccaatatatatgacctgcaaatgatacgaaaaagtgcagcatttagtggcagttaacaagagtgacaagcctggggcagaggtaccaaacctctcccaccagagagctagaagtattttatacagtaactttgatcttatggaagtgaccttcaatgcttattctgaagtaacctatatggtggatacaggatgaacattcagtgccagggagaatcttctcaggttggttctcgttagagtgataaactggctaggggccatagtattggtcctgttaggtttcggtcatggaaaaaaaaattattttggggtcatcctggctctagatgttatgggcaaatttctgaaacatctgcaagaaggtaccagttaattatagtgcttaatattgggaataagattaagcattataattataatgtatgggcctgttggtgtaagctcagataattaaataaaaatagcatgactcaaatgagacatattctgctgaacagtttctacttcctctcccgcctgtcctgtcatgggagacgtgtatagttgctgctgtttcagcaaaccaccataagacgaaaatgcctcaggttgggttgccagtcctttacaactcagcttgaatttcacaacagtgattgtgagaatctgcgtggtatacactgaaatatcggtgtgctgtgatgcaaagcttacctttgacgatattgaatgtgatatagctgtagagaagtacttccttgccttatgtgaggatttcaaacttatttaaattatgtagacaaatcaaagtggcattgcttaatttttagcaggcataataagcaagttaacagtaaaatgcaaaacatgataagcgttgctcaatttttagcaggtataataagcaggttaacagtaaaaatgcaaaacatgatagataagtcactttgaaaattcaaaccaaagttccttcaccttatggaaataggaaattatggacttcaaaattggacacttcctgtttacaaaaagaaattcagagctaaaatcatggtaaaaaaaaatagaaacacttgagaactatggtctttatgggtgcaatttgaaatccttttcatcatcttaccagactaaactaagagcacataccaaacctatcttatggttgaaagttggggtttattttttatatgagaatattatcactattacataacatactcaggacaaagaactttgctcagggaacataccatgtaatatttttgttgtttctttacagactagtctacagtcctgcttactcaaaacaaaccaaataacttatacctttatataagtattatgtactgatgatagtaactacctctgagtttgacacagatcaaaatttttgaatatcagatatcagttatcctatttttatttcatgtgaaaactcctctaaagcagattccctcaactctgtgcatatgtgaatatcactgatgtgaacacattgttcatttacataggtaaaatattactctgtttacagcaaaaggctacctcatagttgatacatagcacacctgtatgtatgctgttccagccttacaggtggctgataattctctggtacagaacctttttatctgtattataaatagcaattcacaactgcatgtttctgacaaacacttgtgaataatgaagcatctcgttttagttagcaaagtctccaaacatttccttaaaataatcatgtatttagtttaaagaattatgggcactgttcaacttaagcaaaacagaacacggaagcagtcttagaagcaccactttgcccagaggtggaggttggaaggggtagcagggagaggggttggtgtatgcaggtattcatgctaggcaaagagtttaaaagacgccaatgtccttcatttactgtctgtgctgccctgaagccaagcgtattgcagcattatagccccaggcacataactaactagcactggcttgccaaggaatgaacatgcaatgccattactagctattgagggaaaagggtctgtgtgaagcatcactttgcagggattactaatggtggggcagcaggtctgtgaattaagttatctcttgacctcaccctcatgtcaacacaaatgtaattcctaaacaagatgcattgccagtctcttagccctgtaagctgatcttttgctacatggcagactataatgaaaacatttttatacttgggtttctagtcttcactagaaggccttggatgtatttttgcagttgaaagatttagaaagatttttacctgcttataacttggaagtttagagtgcaatgtaagaaaaaagatcaagaaatgtcatgttattagcatcagtccacctccaatattgccgatactttttttattctggctcagttttattttgcaccagtgcggccccaagttactgctggttgtatttagtttgtgaataggagcccataagtgttaatagactttgtaacattcactataagatgaattatacaggacatgggaaatctcattaagtcttaaagttaatttaaattaatttatctgttttctctaagaaatgtttatcataaaatatatatgtgtatttcccctttggttataaaatttgggaaagtatgtacaagtgcagctgcactgactttaattttctagatgtcttaatgagatttatttgttttagagaagaacatcttgttaaaagcatcaaactctgtcttacatagctgtcaacagcctctttaagatgtggtggttgtatgatctgtgtcttaattgttcagttagagtgagaagttgacctatgattcatttttaaattttatatttggaacaaagctgcaagttatggtaaagtactgtactgtgagaagtattatgatatttaatgcatctgtggcttaacacttgtgagagttaccagcttgaaaatgatggtgttgactacctcttgaatcacatctatcaaccactggcacctaccaccaagctggcttcaattagtatgtgttgctttttggtattaacaactaaccgtactagagaccaaagtgaaccctgatttttatatgtctttaataatggtgttttatctagtgtttttaaattatcctgtgtagtatttagattacctcattgtccattttgactcatgttgtttacaagtgaaaataaaaacacttgaactgtatgtttttaaaagacaaaaaaggggtagatgtttggaatgcgtttcactcgcatgcagtcatctggagggactgaagcactgtttgcctttctgtacactctgggttttatattctcatttcatgcctaatgtcttattctgtcaattatggatatgttgaggtttaaaaaaattacttgattaaaaataaaacatataacgttggcattta

SEQ ID NO: 16345 - DNA, 6127 bp, Homo sapiens
gaggttactggtggtggcggcggcggcggcggcccgggctccggctgtcggggaagctgctgagctgtgatggtgatgacgaggtgaaaatggcggatctttcgaaatacaatcccggcccctgacataccagaggcggcggcgacggcgacgtcgccaccccggctcccttctcggtccccgggtaccctggagcgctccagtttggacaaactgggaaaggaagctgctggccagagctatcgtgcacgggcaaaacaagccccgccggggctcgggattgcccaggaccttctggagcccctacctcggagcccgagggaggagaaagcggcagccgctggagtgcctgatcaactttctagcgggagaacgatcatggaggtggtgccagctgaggtgaatagtttgcttccagaggaaataatggacactggtataactttagtggatgatgatagtattgaggctgttattgtttcatccccaattcccatggagacagaactggaagaaattgtcaacataaattctactggtgactctacagccacgcccatttccacggaaccaatcacagtgtacagtaaccacactaaccaagttgcagtgaataccacaattactaaagcagattctaataccacagtgaaaccagcttttccaagtggccttcaaaaacttggtgctcagactcctgtgactatatcagccaatcagattattttaaacaaagtatcacagacatctgatcttaaacttggcaatcagacccttaaaccagatggacagaagttaattttaacaactttgggcaagtctggttcaccaattgttttagcactaccccatagccaactaccccaggctcagaaagttacaactcaggcccagtcaggagatgctaagttaccaccgcagcaaattaaagtagttaccattggagggaggccagaggtgaaacctgtcattggtgtctcagcattgaccccaggaagtcaactgattaatactacaactcagccctctgtgttacagacccaacagttaaaaacagtacagattgctaagaagcctcgaacgccaacctctggtccagtaatcacgaagctgatctttgcaaaaccaattaatagtaaagcagttacaggacagacaactcaagtttcaccaccagttattgcaggtagggttctttcacagtctactcccggaactccatcaaagaccataacaatatctgaaagtggtgttattggatcaactttaaattctacaacacagacaccaaataaaatagccatctcacctttgaaatcgccaaataaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcctgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagacttttttttttttttttttgagacggagtctcgctgtgtagcccaggctggagtgcaatggtgagatctcagctcactgcaacgcctctgcctcccaggttcaagcgattctcctgcctcagcctcccgtgtagctgggactacaggtgcatgccaccatgcccggctcattttttgtatttttagtagagacggggtttcaccgtgttagccaggatggtctcgatctcctgacctcgtgattcgcccgcctcggcctcccaaagtgctgggattacaggcataagccgccgtgccaggccctttttatagacttttgaactaagaggtttcaaaccaaatcgcaactcttacttgatttacagaaatgggcctcctaacaaaattttcaaaattgtggtgggatttctttttataagggaagtttaatatggcattattttcagccagtgatttggaaggtctgttttcctataattactaaaataacctaaatcattttcagtattcaaaaactctatgaatttaagagcctgttgtgacaggactcttgattttatgacaagaaaaaaccatgttggaattcaggcattttgttaggtaccttaatcatcagtaattagtatatgattatttcatttcctacaaggactctatagttgtatgtattaagtgtgtatatatgttcatatgaacatgcaagatataggcaatagaaattaagtaatccaaaagaggattccgttattcactaaagtatcttccttttaaatttggatttataaaatcatagtgcagtaactttaaatgtagatagttcaaacattcttagcacctcaatctagtatgtttaattaaaatttgtataaatgtaaattagtgtaagagggtaaaataataatcaagttatttttcaaaagattgcaataagtttttggtctaaacttaaactttgttcattttgtacatactctgtgttaattctaattgcacctttgtgatgtgtatttatatacagtgtgcagaaaatgttcgtgaaattttgattacaattgtagattatgtatgatggcattgcttacgaatgttttgcttgtaaaaaaatttcaaggtgcaatcaaatgctactagtttttctgattttcaaaaatctatctatctaaaatattaagccttttccttcctgtgtagtacttactaaataactttttgtattcaggcatttgcatcaaattgctgaacaagatgaatagccacattaattcaatgattttaaaagactatttggggagggttgggtatataattttttagctctatttacatcccaaagtagaaagattaaatttatatttactagagctattcaaagaatacacttttctatattgtaaaaacaggacagcaaagtaaatcatacagaaaataaacatttatactattctgtaaaaaaggttttgcattttttctttagtataataacaccactttattaaccatttaatatgcaaaaaaccttttaaattatctgaagtaaatttgacattacttctgaaaacacacaactaaaaaattctatcattttgctcagttattactaacataaattgctttgaaatgagaatatgtcttctctttttttccccactgtttcttttaagagcagaaactcagccgggcatggtggctcacgcctgtaattccagcactttgggaggtcaaggcgggtgaatcacttgagtccaggagttctagaccagcccaggctacatggtgaaaccctgtctctactaaaaatataaaaaaattcactgcgtgtggtggcgcacacctgcagtcctcgctactttgaaggcctgagcctgcagaggttgaggctgtagtgagtcaaaattacaccactgcactccagcctggcaatcagagtgagaccttgtctcaaaaacaaaaatacctagaaaatcaatctactctgtcttttaatgtgaaatgttcttatgatagctatctttcttagtttcctttttttctgaagcactaaacacaacctgtaggtcttatctctggggtctgggaaacagaaccttaatgttacaggtacaaaagcaaacagagtgattagttccccattttctggtagtgaacaactgacattttttcaatcttatgtaaaatgtgaataaaaataattttagaaaagttatctatttttattgttctgtaacacaaatagttaagaaaatgaatacttgttatgtaaatgaagcttcacagcaggacctccggccataactttgatcatgttgtatctcttaagcattttatataggaattctggtgtggctacccaaagcagaagggaaggcaatcaactaaaaatccctttctattggagttattttcatcatgtaaattacttcaggcttttcttgttagggcttcttgaatgcacattttgtcattatctgtataccaaaggtgagcttttttttttaatccatgtgattttatgagttgaaagctataaggttttttttaattaaaaatttccttctaaatggcaaa

SEQ ID NO: 16346 - DNA, 5625 bp, Homo sapiens
atggaggtggtgccagctgaggtgaatagtttgcttccagaggaaataatggacactggtataactttagtggatgatgatagtattgaggctgttattgtttcatccccaattcccatggagacagaactggaagaaattgtcaacataaattctactggtgactctacagccacgcccatttccacggaaccaatcacagtgtacagtaaccacactaaccaagttgcagtgaataccacaattactaaagcagattctaataccacagtgaaaccagcttttccaagtggccttcaaaaacttggtgctcagactcctgtgactatatcagccaatcagattattttaaacaaagtatcacagacatctgatcttaaacttggcaatcagacccttaaaccagatggacagaagttaattttaacaactttgggcaagtctggttcaccaattgttttagcactaccccatagccaactaccccaggctcagaaagttacaactcaggcccagtcaggagatgctaagttaccaccgcagcaaattaaagtagttaccattggagggaggccagaggtgaaacctgtcattggtgtctcagcattgaccccaggaagtcaactgattaatactacaactcagccctctgtgttacagacccaacagttaaaaacagtacaggtagggttctttcacagtctactcccggaactccatcaaagaccataacaatatctgaaagtggtgttattggatcaactttaaattctacaacacagacaccaaataaaatagccatctcacctttgaaatcgccaaataaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcctgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagacttttttttttttttttttgagacggagtctcgctgtgtagcccaggctggagtgcaatggtgagatctcagctcactgcaacgcctctgcctcccaggttcaagcgattctcctgcctcagcctcccgtgtagctgggactacaggtgcatgccaccatgcccggctcattttttgtatttttagtagagacggggtttcaccgtgttagccaggatggtctcgatctcctgacctcgtgattcgcccgcctcggcctcccaaagtgctgggattacaggcataagccgccgtgccaggccctttttatagacttttgaactaagaggtttcaaaccaaatcgcaactcttacttgatttacagaaatgggcctcctaacaaaattttcaaaattgtggtgggatttctttttataagggaagtttaatatggcattattttcagccagtgatttggaaggtctgttttcctataattactaaaataacctaaatcattttcagtattcaaaaactctatgaatttaagagcctgttgtgacaggactcttgattttatgacaagaaaaaaccatgttggaattcaggcattttgttaggtaccttaatcatcagtaattagtatatgattatttcatttcctacaaggactctatagttgtatgtattaagtgtgtatatatgttcatatgaacatgcaagatataggcaatagaaattaagtaatccaaaagaggattccgttattcactaaagtatcttccttttaaatttggatttataaaatcatagtgcagtaactttaaatgtagatagttcaaacattcttagcacctcaatctagtatgtttaattaaaatttgtataaatgtaaattagtgtaagagggtaaaataataatcaagttatttttcaaaagattgcaataagtttttggtctaaacttaaactttgttcattttgtacatactctgtgttaattctaattgcacctttgtgatgtgtatttatatacagtgtgcagaaaatgttcgtgaaattttgattacaattgtagattatgtatgatggcattgcttacgaatgttttgcttgtaaaaaaatttcaaggtgcaatcaaatgctactagtttttctgattttcaaaaatctatctatctaaaatattaagccttttccttcctgtgtagtacttactaaataactttttgtattcaggcatttgcatcaaattgctgaacaagatgaatagccacattaattcaatgattttaaaagactatttggggagggttgggtatataattttttagctctatttacatcccaaagtagaaagattaaatttatatttactagagctattcaaagaatacacttttctatattgtaaaaacaggacagcaaagtaaatcatacagaaaataaacatttatactattctgtaaaaaaggttttgcattttttctttagtataataacaccactttattaaccatttaatatgcaaaaaaccttttaaattatctgaagtaaatttgacattacttctgaaaacacacaactaaaaaattctatcattttgctcagttattactaacataaattgctttgaaatgagaatatgtcttctctttttttccccactgtttcttttaagagcagaaactcagccgggcatggtggctcacgcctgtaattccagcactttgggaggtcaaggcgggtgaatcacttgagtccaggagttctagaccagcccaggctacatggtgaaaccctgtctctactaaaaatataaaaaaattcactgcgtgtggtggcgcacacctgcagtcctcgctactttgaaggcctgagcctgcagaggttgaggctgtagtgagtcaaaattacaccactgcactccagcctggcaatcagagtgagaccttgtctcaaaaacaaaaatacctagaaaatcaatctactctgtcttttaatgtgaaatgttcttatgatagctatctttcttagtttcctttttttctgaagcactaaacacaacctgtaggtcttatctctggggtctgggaaacagaaccttaatgttacaggtacaaaagcaaacagagtgattagttccccattttctggtagtgaacaactgacattttttcaatcttatgtaaaatgtgaataaaaataattttagaaaagttatctatttttattgttctgtaacacaaatagttaagaaaatgaatacttgttatgtaaatgaagcttcacagcaggacctccggccataactttgatcatgttgtatctcttaagcattttatataggaattctggtgtggctacccaaagcagaagggaaggcaatcaactaaaaatccctttctattggagttattttcatcatgtaaattacttcaggcttttcttgttagggcttcttgaatgcacattttgtcattatctgtataccaaaggtgagcttttttttttaatccatgtgattttatgagttgaaagctataaggttttttttaattaaaaatttccttctaaatggcaaa

SEQ ID NO: 16347 - DNA, 5482 bp, Homo sapiens
atggaggtggtgccagctgaggtgaatagtttgcttccagaggaaataatggacactggtataactttagtggatgatgatagtattgaggctgttattgtttcatccccaattcccatggagacagaactggaagaaattgtcaacataaattctactggtgactctacagccacgcccatttccacggaaccaatcacagtgtacagtaaccacactaaccaagttgcagtgaataccacaattactaaagcagattctaataccacagtgaaaccagcttttccaagtggccttcaaaaacttggtgctcagactcctgtgactatatcagccaatcagattattttaaacaaagtatcacagacatctgatcttaaacttggcaatcagacccttaaaccagatggacagaagttaattttaacaactttgggcaagtctggttcaccaattgttttagcactaccccatagccaactaccccaggctcagaaagttacaactcaggcccagtcaggagatgctaagttaccaccgcagcaaattaaagtagttaccattggagggaggccagaggtgaaacctgtcattggtgtctcagcattgaccccaggaagtcaactgattaatactacaactcagccctctgtgttacagacccaacagttaaaaacagtacaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcctgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagacttttttttttttttttttgagacggagtctcgctgtgtagcccaggctggagtgcaatggtgagatctcagctcactgcaacgcctctgcctcccaggttcaagcgattctcctgcctcagcctcccgtgtagctgggactacaggtgcatgccaccatgcccggctcattttttgtatttttagtagagacggggtttcaccgtgttagccaggatggtctcgatctcctgacctcgtgattcgcccgcctcggcctcccaaagtgctgggattacaggcataagccgccgtgccaggccctttttatagacttttgaactaagaggtttcaaaccaaatcgcaactcttacttgatttacagaaatgggcctcctaacaaaattttcaaaattgtggtgggatttctttttataagggaagtttaatatggcattattttcagccagtgatttggaaggtctgttttcctataattactaaaataacctaaatcattttcagtattcaaaaactctatgaatttaagagcctgttgtgacaggactcttgattttatgacaagaaaaaaccatgttggaattcaggcattttgttaggtaccttaatcatcagtaattagtatatgattatttcatttcctacaaggactctatagttgtatgtattaagtgtgtatatatgttcatatgaacatgcaagatataggcaatagaaattaagtaatccaaaagaggattccgttattcactaaagtatcttccttttaaatttggatttataaaatcatagtgcagtaactttaaatgtagatagttcaaacattcttagcacctcaatctagtatgtttaattaaaatttgtataaatgtaaattagtgtaagagggtaaaataataatcaagttatttttcaaaagattgcaataagtttttggtctaaacttaaactttgttcattttgtacatactctgtgttaattctaattgcacctttgtgatgtgtatttatatacagtgtgcagaaaatgttcgtgaaattttgattacaattgtagattatgtatgatggcattgcttacgaatgttttgcttgtaaaaaaatttcaaggtgcaatcaaatgctactagtttttctgattttcaaaaatctatctatctaaaatattaagccttttccttcctgtgtagtacttactaaataactttttgtattcaggcatttgcatcaaattgctgaacaagatgaatagccacattaattcaatgattttaaaagactatttggggagggttgggtatataattttttagctctatttacatcccaaagtagaaagattaaatttatatttactagagctattcaaagaatacacttttctatattgtaaaaacaggacagcaaagtaaatcatacagaaaataaacatttatactattctgtaaaaaaggttttgcattttttctttagtataataacaccactttattaaccatttaatatgcaaaaaaccttttaaattatctgaagtaaatttgacattacttctgaaaacacacaactaaaaaattctatcattttgctcagttattactaacataaattgctttgaaatgagaatatgtcttctctttttttccccactgtttcttttaagagcagaaactcagccgggcatggtggctcacgcctgtaattccagcactttgggaggtcaaggcgggtgaatcacttgagtccaggagttctagaccagcccaggctacatggtgaaaccctgtctctactaaaaatataaaaaaattcactgcgtgtggtggcgcacacctgcagtcctcgctactttgaaggcctgagcctgcagaggttgaggctgtagtgagtcaaaattacaccactgcactccagcctggcaatcagagtgagaccttgtctcaaaaacaaaaatacctagaaaatcaatctactctgtcttttaatgtgaaatgttcttatgatagctatctttcttagtttcctttttttctgaagcactaaacacaacctgtaggtcttatctctggggtctgggaaacagaaccttaatgttacaggtacaaaagcaaacagagtgattagttccccattttctggtagtgaacaactgacattttttcaatcttatgtaaaatgtgaataaaaataattttagaaaagttatctatttttattgttctgtaacacaaatagttaagaaaatgaatacttgttatgtaaatgaagcttcacagcaggacctccggccataactttgatcatgttgtatctcttaagcattttatataggaattctggtgtggctacccaaagcagaagggaaggcaatcaactaaaaatccctttctattggagttattttcatcatgtaaattacttcaggcttttcttgttagggcttcttgaatgcacattttgtcattatctgtataccaaaggtgagcttttttttttaatccatgtgattttatgagttgaaagctataaggttttttttaattaaaaatttccttctaaatggcaaa

SEQ ID NO: 16348 - DNA, 4254 bp, Homo sapiens
ctttcgaaatacaatcccggcccctgacataccagaggcggcggcgacggcgacgtcgccaccccggctcccttctcggtccccgggtaccctggagcgctccagtttggacaaactgggaaaggaagctgctggccagagctatcgtgcacgggcaaaacaagccccgccggggctcgggattgcccaggaccttctggagcccctacctcggagcccgagggaggagaaagcggcagccgctggagtgcctgatcaactttctagcgggagaacgatcatggaggtggtgccagctgagattgctaagaagcctcgaacgccaacctctggtccagtaatcacgaagctgatctttgcaaaaccaattaatagtaaagcagttacaggacagacaactcaagtttcaccaccagttattgcaggtagggttctttcacagtctactcccggaactccatcaaagaccataacaatatctgaaagtggtgttattggatcaactttaaattctacaacacagacaccaaataaaatagccatctcacctttgaaatcgccaaataaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcctgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagacttttttttttttttttttgagacggagtctcgctgtgtagcccaggctggagtgcaatggtgagatctcagctcactgcaacgcctctgcctcccaggttcaagcgattctcctgcctcagcctcccgtgtagctgggactacaggtgcatgccaccatgcccggctcattttttgtatttttagtagagacggggtttcaccgtgttagccaggatggtctcgatctcctgacctcgtgattcgcccgcctcggcctcccaaagtgctgggattacaggcataagccgccgtgccaggccctttttatagacttttgaactaagaggtttcaaaccaaatcgcaactcttacttgatttacagaaatgggcctcctaacaaaattttcaaaattgtggtgggatttctttttataagggaagtttaatatggcattattttcagccagtgatttggaaggtctgttttcctataattactaaaataacctaaatcattttcagtattcaaaaactctatgaatttaagagcctgttgtgacaggactcttgattttatgacaagaaaaaaccatgttggaattcaggcattttgttaggtaccttaatcatcagtaattagtatatgattatttcatttcctacaaggactctatagttgtatgtattaagtgtgtatatatgttcatatgaacatgcaagatataggcaatagaaattaagtaatccaaaagaggattccgttattcactaaagtatcttccttttaaatttggatttataaaatcatagtgcagtaactttaaatgtagatagttcaaacattcttagcacctcaatctagtatgtttaattaaaatttgtataaatgtaaattagtgtaagagggtaaaataataatcaagttatttttcaaaagattgcaataagtttttggtctaaacttaaactttgttcattttgtacatactctgtgttaattctaattgcacctttgtgatgtgtatttatatacagtgtgcagaaaatgttcgtgaaattttgattacaattgtagattatgtatgatggcattgcttacgaatgttttgcttgtaaaaaaatttcaaggtgcaatcaaatgctactagtttttctgattttcaaaaatctatctatctaaaatattaagccttttccttcctgtgtagtacttactaaataactttttgtattcaggcatttgcatcaaattgctgaacaagatgaatagccacattaattcaatgattttaaaagactatttggggagggttgggtatataattttttagctctatttacatcccaaagtagaaagattaaatttatatttactagagctattcaaagaatacacttttctatattgtaaaaacaggacagcaaagtaaatcatacagaaaataaacatttatactattctgtaaaaaa

SEQ ID NO: 16349 - DNA, 4083 bp, Homo sapiens
actggtggtggcggcggcggcggcggcccgggctccggctgtcggggaagctgctgagctgtgatggtgatgacgagtgcctgatcaactttctagcgggagaacgatcatggaggtggtgccagctgagattgctaagaagcctcgaacgccaacctctggtccagtaatcacgaagctgatctttgcaaaaccaattaatagtaaagcagttacaggacagacaactcaagtttcaccaccagttattgcaggtagggttctttcacagtctactcccggaactccatcaaagaccataacaatatctgaaagtggtgttattggatcaactttaaattctacaacacagacaccaaataaaatagccatctcacctttgaaatcgccaaataaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcctgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagacttttttttttttttttttgagacggagtctcgctgtgtagcccaggctggagtgcaatggtgagatctcagctcactgcaacgcctctgcctcccaggttcaagcgattctcctgcctcagcctcccgtgtagctgggactacaggtgcatgccaccatgcccggctcattttttgtatttttagtagagacggggtttcaccgtgttagccaggatggtctcgatctcctgacctcgtgattcgcccgcctcggcctcccaaagtgctgggattacaggcataagccgccgtgccaggccctttttatagacttttgaactaagaggtttcaaaccaaatcgcaactcttacttgatttacagaaatgggcctcctaacaaaattttcaaaattgtggtgggatttctttttataagggaagtttaatatggcattattttcagccagtgatttggaaggtctgttttcctataattactaaaataacctaaatcattttcagtattcaaaaactctatgaatttaagagcctgttgtgacaggactcttgattttatgacaagaaaaaaccatgttggaattcaggcattttgttaggtaccttaatcatcagtaattagtatatgattatttcatttcctacaaggactctatagttgtatgtattaagtgtgtatatatgttcatatgaacatgcaagatataggcaatagaaattaagtaatccaaaagaggattccgttattcactaaagtatcttccttttaaatttggatttataaaatcatagtgcagtaactttaaatgtagatagttcaaacattcttagcacctcaatctagtatgtttaattaaaatttgtataaatgtaaattagtgtaagagggtaaaataataatcaagttatttttcaaaagattgcaataagtttttggtctaaacttaaactttgttcattttgtacatactctgtgttaattctaattgcacctttgtgatgtgtatttatatacagtgtgcagaaaatgttcgtgaaattttgattacaattgtagattatgtatgatggcattgcttacgaatgttttgcttgtaaaaaaatttcaaggtgcaatcaaatgctactagtttttctgattttcaaaaatctatctatctaaaatattaagccttttccttcctgtgtagtacttactaaataactttttgtattcaggcatttgcatcaaattgctgaacaagatgaatagccacattaattcaatgattttaaaagactatttggggagggttgggtatataattttttagctctatttacatcccaaagtagaaagattaaatttatatttactagagctattcaaagaatacacttttctatattgtaaaaacaggacagcaaagtaaatcatacagaaaataaacatttatactattctgtaaaaaa

SEQ ID NO: 16350 - DNA, 2742 bp, Homo sapiens
gcggcggtggaatggggctgggcgcgtgattttgaacaaaccctggtctgtgtctcggaggcgccgccgccgccgctgctgctgggagcccagggagcgccgcgcgaccaggaggcggcggcgccgccggctttgtgcctgatcaactttctagcgggagaacgatcatggaggtggtgccagctgaggtgaatagtttgcttccagaggaaataatggacactggtataactttagtggatgatgatagtattgaggctgttattgtttcatccccaattcccatggagacagaactggaagaaattgtcaacataaattctactggtgactctacagccacgcccatttccacggaaccaatcacagtgtacagtaaccacactaaccaagttgcagtgaataccacaattactaaagcagattctaataccacagtgaaaccagcttttccaagtggccttcaaaaacttggtgctcagactcctgtgactatatcagccaatcagattattttaaacaaagtatcacagacatctgatcttaaacttggcaatcagacccttaaaccagatggacagaagttaattttaacaactttgggcaagtctggttcaccaattgttttagcactaccccatagccaactaccccaggctcagaaagttacaactcaggcccagtcaggagatgctaagttaccaccgcagcaaattaaagtagttaccattggagggaggccagaggtgaaacctgtcattggtgtctcagcattgaccccaggaagtcaactgattaatactacaactcagccctctgtgttacagacccaacagttaaaaacagtacagattgctaagaagcctcgaacgccaacctctggtccagtaatcacgaagctgatctttgcaaaaccaattaatagtaaagcagttacaggacagacaactcaagtttcaccaccagttattgcaggtagggttctttcacagtctactcccggaactccatcaaagaccataacaatatctgaaagtggtgttattggatcaactttaaattctacaacacagacaccaaataaaatagccatctcacctttgaaatcgccaaataaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcctgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgt

SEQ ID NO: 16351 - DNA, 2257 bp, Homo sapiens
accctggtctgtgtctcggaggcgccgccgccgccgctgctgctgggagcccagggagcgccgcgcgaccaggaggcggcggcgccgccggctttgtgcctgatcaactttctagcgggagaacgatcatggaggtggtgccagctgagattgctaagaagcctcgaacgccaacctctggtccagtaatcacgaagctgatctttgcaaaaccaattaatagtaaagcagttacaggacagacaactcaagtttcaccaccagttattgcaggtagggttctttcacagtctactcccggaactccatcaaagaccataacaatatctgaaagtggtgttattggatcaactttaaattctacaacacagacaccaaataaaatagccatctcacctttgaaatcgccaaataaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcctgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcacttt

SEQ ID NO: 16352 - DNA, 755 bp, Homo sapiens
gccggcgccagggcaggcgggcggctggcagctgtggcgccgacatggctgcgctggtggagccgctggggctggagcgggacgtgtcccgggcggttgagctcctcgagcggctccagcgcagcggggagctgccgccgcagaagctgcaggccctccagcgagttctgcagagccgcttctgctccgctatccgagaggtgtatgagcagctttatgacacgctggacatcaccggcagcgccgagatccgagcccatgccacagccaaggccacagtggctgccttcacagccagcgagggccacgcacatcccagggtagtggagctacccaagacggatgagggcctaggcttcaacatcatgggtggcaaagagcaaaactcgcccatctacatctcccgggtcatcccagggggtgtggctgaccgccatggaggcctcaagcgtggggatcaactgttgtcggtgaacggtgtgagcgttgagggtgagcagcatgagaaggcggtggagctgctgaaggcggcccagggctcggtgaagctggttgtccgttacacaccgcgagtgctggaggagatggaggcccggttcgagaagatgcgctctgcccgccggcgccaacagcatcagagctactcgtccttggagtctcgaggttgaaaccacagatctggacgttcacgtgcactctcttcctgtacagtatttattgttcctggcactttatttaaagatatttgaccctca

SEQ ID NO: 16353 - DNA, 4688 bp, Homo sapiens
gtctgtaggttaagggagaagatggcggcgctaggggaacccgtgcggctggagagagatatttgtagagcaattgaattattggaaaaactacaaaggagtggagaagtaccaccacagaaacttcaggctttgcaaagagtccttcaaagtgaattctgcaatgctgtgagagaggtatatgaacatgtctatgagactgtggacatcagtagcagtcctgaagtgagagcgaacgctactgcaaaggctactgttgctgcatttgctgccagtgaaggacattctcatcctcgagttgttgagctaccaaaaacagaagagggccttggattcaatattatgggaggcaaagaacaaaactctccaatctatatatcccgaataattccaggtggaattgctgatagacatgggggcctcaaacgtggagatcaactcctctctgttaatggagtgagtgttgaaggagaacatcatgaaaaagctgtagaactgctgaaagccgcacaaggaaaggttaaattagtggtacgatacacacccaaagtcttagaagaaatggagtcgcgctttgaaaaaatgagatcagcaaaacgcaggcaacagacctaatacatttcaaaacttgatatttcattttgcgttttagctagagaagttttccttgtgacttactaatggctgcaatgccaatgattgtaagaaaacaaacaaatttatcatgaaattctccttgtcattttataaatgcctattttaacatcatttatggttccagagatgcatacacttttttctgacaagaaaaagtaaaaggtgatgagggcaattctgtcctactgtttttacaggcctttttcaaatgcagattttgtcataaagttgttatagattttttaaaatgcttttttaatattaaaatgtacttttacattcttaatctttttttagaaaggaaaagttttcttcatttagctgctgatttaaaagtaaagttctccaattctttttttttgcttactctattttttttaacctgtgaaatttctttacagttttccaagaaattaagcataacagtctcatctacggcagttcattacactgtcaatgttaacatcattgctgcattttgtactttgaacacacacataatatatataaccagtggtaaatcatgactcagtacagtgcaagttttttcacttttacttaaacataatatataatggatattcatttatactgatttatgaaagtaagtttttaaacactgaaacaatcattgctaaaatacatattcttaatatttgagcattgaggcaagaggatgtaattgatagcattacttattacatccctatttatgttcaaccgtacatcaaattataaatgcaaaacaggttcagatttcatcttttgtgatttcttttaaatactattcatttttatttaaatgcacagtatttcccctatattttagtccttccattcctagagacaaaccagttatttggtggtgggaagtagctgaagcaaagaaggaaaagtaatacctttaacctcactagcttcaagagtagacattcttactagctcaatttaaataattgattttaaataggaagaaaagaggatatatttaagatacatagaaattatgatgtgaagtattcatgagaatctgtagattccatcaaaataagtaggaactcatactaaaattgttggatttaaagaggcaacttttgtttatgattcaaatatgggaatttgagaaatatttcatttgtccactggatgtcactattttactaaaaggcagctattagtgtgggactgtgactgaggtcttaaagactgaaagagttggggttcattttctgttacaacttacaggaacatttgtactttaagaaaaatttaagtgacaaatgttagaagatgatggattgaaaaatataagtaatttggcatattgaccctatataaaaaagtgggcattttgtaacattccttcaggaagaatagaattgtatgcttttttctgcatgtttgtgatcactgtgagtctcagatgattattccagttttcaatgatttttcaaaataaaagtcaatcagcattgttatttatcattaaggtattgaacactggattgcatggttgaatgtgtctttaatccactacaaaatgtgcttgttattgataggatcatgttgttaaattgtaaattttcaaaattaattgatgttttaaaaatgttgagaccaaagtagtatagaagtatggacttaatttaattgtaaaattattagaggtatttgttgtagagctttatatattaaagagaggtattggtgcatataaaaacagtaatattattgttatgcttgtattcttgcatttcagggtaagtaaaccctgaagaaatcttattttagtatagctacagctgcagtagcttttaagtatgtatcaacatttcattataaattatagcttcctggttctgtgtctcagctgtttcagaactttcagccaagttaaatcttttttggtgttgaaacttttagtaagttgagtaagctatttttttccctacggtaatccacaatctgttctttgtgtgggttgacacctatttataattcttaaaataagggtagctcaaaggagccaagtacagtagtttagcttgctactgttgagcatgaatagcagtaggttgttttcattaatgcagttttcataatgtatcccagaattttaaatcttgaccatagaaaaatacagtcattcattggcaaagatgtacagtggtggtttagtgcagtgaggaaatgatgggaatttttatcttagaaatggatgattcgtgaataaaactaggtacatagtaagtgtatgatagatgtttgatttgtaaattacaaatataaattatcacccccatttccatttattttcttgatatatcaaaatgtgttgacttagtgattctcaatcttagctacatattagcctggcagagctttaaaaaattgatacctgggtcctattccataacaactaaatcaaaatcacccttttttttttttttgtaaagctttccaggtggttctaaaggacacctagggtcaataacccattataaaatgatctgattacactggacactcttaggaagtatcaaaatagaacagttcaatttgcagctacttaatgattaattacatttcttaggttttttttttgttttttttttggtttgtttgttttttgttttaaaagagacaggatcttgctttgtctcccaggctggaacacagtggtgtgatcatagctcactgcagcctgaaactccttggcttccacctcagcctcccaaagcattaggattataggcgtgagccactgcacctggccaagtaatttcttttaggaataaaaggtacttggcattccttatttgggaagtaattacagtcttatctttttttttcttttttcttttttttaataaaatctaccagtaatttaaatgtgagctttttatgtctgtcatcattctgccccctttgcctttaaaacttacaaaaatacgtgtttgttatttgagaaagcatgtttaaaaattgcagatgagaaatattgtcgttaataattatgtactgtcttaatgtgggcacttcatttgttagtataatactagataatagcagcctagttctttaggatttgacgattcaaattttttttttgttttttgtttttgtttttttttgagacagagtcttgctctgttgcccaggctggcgtgcagtggtgtgatctcggctcacttcagcctccgccacctcaaggcagttcaagcaattctcctgcctcagcctcccgagtagctaggactacaggcgtgtgccacctctcccggctaatttttttgtatttttagtagagacggggtttcaccgtgttagccaggatgatctcgatctcctgacctcgtgattcgcccgcctcggcctcccaaagtgctggaattactggcgtgagccaccatgcccagcctcaaatatgtttttaaaaaatatcattgtcctcctcctcttaagatttttttaagttattttgctcaagtacttaagtagtctggctcaagtactttgtttacaattaaaatggatattatagcatttaatagaagaaatggttatggcttatccaaaaagaatgtcagcatgacctggtgtagacttaaaaaactacatgtttgtgaatattttataatgtggaatgatcattgaaatatcaaggattctagtaattgtatttcctgaataaatgtatgtttatgaattttctaacttacattttgttgtgtcctctgccaacaatctggttttataattgttgtctaaagtttgctagtagtgtttcttcaaaggttattccaggtatggttaagtagtgagaaaaatcacttattaattttcaagaactttgagactaatttgtattgactcggttttttaaaataactggcaaatgctatgcttctacttttaaaatttgtggtaatacccagaatggatgtaaaataacatttttcaatagattacttcatttatcaatttaattctgattttaaggcttatttaaaataaatttgtatgagtta

SEQ ID NO: 16354 - DNA, 759 bp, Homo sapiens
atggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccaagatccccgcagccccggcgggattctgatggtgccaacagtgtggcgagctacgagaacgagggtgcgtctgggatccgaggtgcccaggctgggtggggagtctggggtccgtcctggactaggctgacccctgtgtcgttacccccagaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactga

SEQ ID NO: 16355 - DNA, 1715 bp, Homo sapiens
ggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgagaacgagggtgcgtctgggatccgaggtgcccaggctgggtggggagtctggggtccgtcctggactaggctgacccctgtgtcgttacccccagaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaatt

SEQ ID NO: 16356 - DNA, 1648 bp, Homo sapiens
caggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaactt

SEQ ID NO: 16357 - DNA, 1448 bp, Homo sapiens
gggcctccctgctcgctgcctccccgggtcctggatatggaggccacggctgccagctggcaggtggctgtccccgtcttggggggggccagcagacccttggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaatt

SEQ ID NO: 16358 - DNA, 1645 bp, Homo sapiens
caggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaactt

SEQ ID NO: 16359 - DNA, 1869 bp, Homo sapiens
agtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccaggcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 16360 - DNA, 2360 bp, Homo sapiens
attatcttgctccctgtctattggagtgtatctctcttcctctctgtgtgactttttgtgtttatgtgtgtgtttagtgtgtgtccatattttcctgttctcttgtgtctctctgctgtgtctctctctttttctttctgttttttgagacggagtctccctctgtcacccaggctggagtgcagtggtgcgatctcggctcactgcaacctctgcttctgaggttcaaacgattctcctgcctcagcctcccgagtagctggaattacagacacatgccaccatgcccagctaattttgtatttttaatagagacggggtttcaccatgttggccaggctggtcttaaactcttgaccttacgtgatccacccgcctcggcctcccaaagtttttggattacaggtgtgagccacctcgcccggtcctatctctctttcttctctttctccctctcactttgtttctcttctctctctctctcccgcctccttcccccgtctcccctcccttccccccaccgccctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 16361 - DNA, 581 bp, Homo sapiens
agtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccagggtctgttcctagttgcaacagttcttggaaacccactcgagagggccacgcctccattcaccaggccacggtgggtggtgtgcgtatgttttgctgaggcctggtcatcacgctgtggctccaaggctgggaccagccacagaccgagaagccggtcagcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggc

SEQ ID NO: 16362 - DNA, 2453 bp, Homo sapiens
aggaagcccgccctgcccgcccgccagtgtcagtggtgttggcatcagcttgggcaggtgtgcgggctcaggatggggcggccgtggtgaggaaccctggactctcagcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggggcgtcaggcagggaattctggtgacttcaggggcaaagaagtgggcaccgggtgggtctcccaactccactgcatcctcctggctgcgaccttggaccaagtgacaacctcccagaacttagttcctcacttggtgcccacctctcagagaagacatcgcacacacggccgggcacggtggctcacgcctgtaatcccggcactttgggaggccgaggcaggcagatcacctgaggtcacgagttcgagaccagcctggccaacatggtgaaacttcatctctactaaaaacacaaaaaattagccaggcatggtggtgggtgcctgtagtcccagttagttgggaggctgaggcaggagaatcatttgaaccctgaaggcggaggttgcggtgagttaagatcacatgcactcaaccctgggtgacagagcgagactccgtctcaataaataaataaaaaaacagacattgcacacaaagcctcagcccagcaggcactcggtcaatgctggaaacagacaggaggcagggacgttgggaaatgtaacagtggctgagacgcgctgaggagccaccgcaggccagtgagatggtgcggcgctaagcgctcacacgtgcaccatctcttagcacccaaagccacagagcagttaagccacctgcccaaggccacatcttgaagtaaggggaggaggagatggaatccccagtggtcagacatcagacatcaaagcctaggctgggtctactgcttgggaagcacgatggacccccagagggccttgaaggctgcccaaagtccccatctgggagacccaggccgtcatctcagcgagcaggctggagggtggaaaccacagtgaacctgggtggtcaagagtcagccccagaggcaggtgcaggagtttgagccaaatgtgcagagccccacgtcattcattcaaccagtatccactgggcccctgctacgggcaagtcctgctctaggtgctgggaacaccaacataaagaacagcaaacccctgaccccttagaacttgcattctggtaggagagagaaaacagatagggctggacacagcggtcatgcctataaatcccagcacttcgggaggctgaggcgggaggatcctttgagcctctgagtttgaggccagcctgggcaacatagcaagacctctctctctacaaaaactttttttttttttttttgagacagagtatcactgtcactcaggctggagtgcagtggcgccatctcggctcactgcaacctccacctcctgggttcaagcgattctcgtgcctcagccttccaagtagctgggattacaggcacacgccaccatgtccagcctctataaaaacatttaaaattagccaggcatggtggtggatgccctagagtcccactgacttgggaggctgaggtgggaagatcacttgagcctgggaggtcaaggttgcaatgagccatggttgctgcagtgagctgtggtcgtgccactgcactcaagcctgggcaacagagcaagaccccatctcaaaaaaaaaatttaaaaa

SEQ ID NO: 16363 - DNA, 2527 bp, Homo sapiens
ggagtgtatctctcttcctctctgtgtgactttttgtgtttatgtgtgtgtttagtgtgtgtccatattttcctgttctcttgtgtctctctgctgtgtctctctctttttctttctgttttttgagacggagtctccctctgtcacccaggctggagtgcagtggtgcgatctcggctcactgcaacctctgcttctgaggttcaaacgattctcctgcctcagcctcccgagtagctggaattacagacacatgccaccatgcccagctaattttgtatttttaatagagacggggtttcaccatgttggccaggctggtcttaaactcttgaccttacgtgatccacccgcctcggcctcccaaagtttttggattacaggtgtgagccacctcgcccggtcctatctctctttcttctctttctccctctcactttgtttctcttctctctctctctcccgcctccttcccccgtctcccctcccttccccccaccgccctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccagggtctgttcctagttgcaacagttcttggaaacccactcgagagggccacgcctccattcaccaggccacgcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 16364 - DNA, 585 bp, Homo sapiens
atatcctgttctttccttcaccgtgggagacgagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccagggtctgttcctagttgcaacagttcttggaaacccactcgagagggccacgcctccattcaccaggccacgcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctact

SEQ ID NO: 16365 - DNA, 561 bp, Homo sapiens
ggatgtacggatgattcagtggctggcaggaagcccgccctgcccgcccgccagtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggccatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaag

SEQ ID NO: 16366 - DNA, 2600 bp, Homo sapiens
acatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcggatgggagtcccagcttctggagacggggttcctggggatcttcctgtgccctctgtggacgctgtcaaggctgccccagcatacccccacatcccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagcaacgtttgcccttccctgcgcccagcccaagctgggcatcgccaagagagacgtggagaggagagcggtgggacccagcccccagcacgggggtccagggtggggtctgttgtcacatactgtggcggctcccaggccctgcccacctggggccccacatccaggccaacccttgtcccaggcgccaggggctctgatctcccatccatcccaccctcctcccagaggcccagcctggggctgtgccgcccacaggagttgagacaatggccatcctgacaccttcctccactacagccctgaccatagacccagccaggtagctcttggggtctctagcgtcccagggcctggtttctgttccctcttcaatggtgtgttcccagccaggtcctgaccctcagagccaagtccctgtcacgtctggggcagccaaaccctcgccccacagggacctggacacgcccggccaggatgtggggttggatgggccattttctgtcctatccctcatctccacccccgccacagcctacacgcatcccacacatgcaggcacacacagcctgtgcacacatgtgttcttggcccggtttcatccccccatgactggtgtctgtgaggtgcagatggacacagcgcacacccagaccctccaccaggctgtgacctcgctgcctctgaggccttgacaaggcccctcaatcggaggacagccggccgtgcacactttcatcatcgtcggacaaacagcgtctactgcacatttttcttattcctattcttgagccatagctatggcatattcttctactattcctattataccacttaccagcttactcg

SEQ ID NO: 16367 - DNA, 2600 bp, Homo sapiens
acatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtattccttcagatgggagtcccagcttctggagacggggttcctggggatcttcctgtgccctctgtggacgctgtcaaggctgccccagcatacccccacatcccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagcaacgtttgcccttccctgcgcccagcccaagctgggcatcgccaagagagacgtggagaggagagcggtgggacccagcccccagcacgggggtccagggtggggtctgttgtcacatactgtggcggctcccaggccctgcccacctggggccccacatccaggccaacccttgtcccaggcgccaggggctctgatctcccatccatcccaccctcctcccagaggcccagcctggggctgtgccgcccacaggagttgagacaatggccatcctgacaccttcctccactacagccctgaccatagacccagccaggtagctcttggggtctctagcgtcccagggcctggtttctgttccctcttcaatggtgtgttcccagccaggtcctgaccctcagagccaagtccctgtcacgtctggggcagccaaaccctcgccccacagggacctggacacgcccggccaggatgtggggttggatgggccattttctgtcctatccctcatctccacccccgccacagcctacacgcatcccacacatgcaggcacacacagcctgtgcacacatgtgttcttggcccggtttcatccccccatgactggtgtctgtgaggtgcagatggacacagcgcacacccagaccctccaccaggctgtgacctcgctgcctctgaggccttgacaaggcccctcaatcggaggacagccggccgtgcacactttcatcatcgtcggacaaacagcgtctactgcacatttttcttattcctattcttgagccatagctatggcatattcttctactattcctattataccacttaccagcttactcg

SEQ ID NO: 16368 - DNA, 1091 bp, Homo sapiens
acatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtgcccttccttagcctctgccatcagccttcccagtatgcacggagggcagtgatgggcgcttgtgatctgatccgtgcctcctccctggatgtgggagctcctgggcttccaggccccgggcacctagagacggatggtcgcacgcatgattgtcggcatctcacagcggctcagcacgtcactttggactgtcgcgcagaaattcagaagactcgtagtagcttcggcagtgctctccctgccttccgagcagccatgcgtctttgaactgtcttcccttccctgatcttggagaacatagagctgccagttactgaggatgggagtcccagcttctggagacggggttcctggggatcttcctgtgccctctgtggacgctgtcaaggctgccccagcatacccccacatcccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctg

SEQ ID NO: 16369 - DNA, 853 bp, Homo sapiens
aacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcggtaagtgagatgcatttagagaaagctctgcgagagttgagcgttgtgtgtttggatgggagtcccagcttctggagacggggttcctggggatcttcctgtgccctctgtggacgctgtcaaggctgccccagcatacccccacatcccggattgtcctgtggggcttccggtggctgatcttcaggatcatgcttggagcaggcctgatcaagatccggggggaccggtgctggcgagacctcacctgcatggacttccactatgaggagaagtttgcaggctgtttcctgaggtctgggccagcagcaccgccatgccctgacccaccattcccctggccgcgggctgagtgt

SEQ ID NO: 16370 - DNA, 1947 bp, Homo sapiens
atgcgtggagctggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagcaacgtttgcccttccctgcgcccagcccaagctgggcatcgccaagagagacgtggagaggagagcggtgggacccagcccccagcacgggggtccagggtggggtctgttgtcacatactgtggcggctcccaggccctgcccacctggggccccacatccaggccaacccttgtcccaggcgccaggggctctgatctcccatccatcccaccctcctcccagaggcccagcctggggctgtgccgcccacaggagttgagacaatggccatcctgacaccttcctccactacagccctgaccatagacccagccaggtagctcttggggtctctagcgtcccagggcctggtttctgttccctcttcaatggtgtgttcccagccaggtcctgaccctcagagccaagtccctgtcacgtctggggcagccaaaccctcgccccacagggacctggacacgcccggccaggatgtggggttggatgggccattttctgtcctatccctcatctccacccccgccacagcctacacgcatcccacacatgcaggcacacacagcctgtgcacacatgtgttcttggcccggtttcatccccccatgactggtgtctgtgaggtgcagatggacacagcgcacacccagaccctccaccaggctgtgacctcgctgcctctgaggccttgacaaggcccctcaatcggaggacagccggccgtgcacactttcatcatcgtcggacaaacagcgtctactgcacatttttcttattcctattcttgagccatagctatggcatattcttctactattcctattataccacttaccagcttactcg

SEQ ID NO: 16371 - DNA, 2103 bp, Homo sapiens
aatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtactggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagcaacgtttgcccttccctgcgcccagcccaagctgggcatcgccaagagagacgtggagaggagagcggtgggacccagcccccagcacgggggtccagggtggggtctgttgtcacatactgtggcggctcccaggccctgcccacctggggccccacatccaggccaacccttgtcccaggcgccaggggctctgatctcccatccatcccaccctcctcccagaggcccagcctggggctgtgccgcccacaggagttgagacaatggccatcctgacaccttcctccactacagccctgaccatagacccagccaggtagctcttggggtctctagcgtcccagggcctggtttctgttccctcttcaatggtgtgttcccagccaggtcctgaccctcagagccaagtccctgtcacgtctggggcagccaaaccctcgccccacagggacctggacacgcccggccaggatgtggggttggatgggccattttctgtcctatccctcatctccacccccgccacagcctacacgcatcccacacatgcaggcacacacagcctgtgcacacatgtgttcttggcccggtttcatccccccatgactggtgtctgtgaggtgcagatggacacagcgcacacccagaccctccaccaggctgtgacctcgctgcctctgaggccttgacaaggcccctcaatcggaggacagccggccgtgcacactttcatcatcgtcggacaaacagcgtctactgcacatttttcttattcctattcttgagccatagctatggcatattcttctactattcctattataccacttaccagctt

SEQ ID NO: 16372 - DNA, 2599 bp, Homo sapiens
acatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggttgttttaggatgggagtcccagcttctggagacggggttcctggggatcttcctgtgccctctgtggacgctgtcaaggctgccccagcatacccccacatcccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagcaacgtttgcccttccctgcgcccagcccaagctgggcatcgccaagagagacgtggagaggagagcggtgggacccagcccccagcacgggggtccagggtggggtctgttgtcacatactgtggcggctcccaggccctgcccacctggggccccacatccaggccaacccttgtcccaggcgccaggggctctgatctcccatccatcccaccctcctcccagaggcccagcctggggctgtgccgcccacaggagttgagacaatggccatcctgacaccttcctccactacagccctgaccatagacccagccaggtagctcttggggtctctagcgtcccagggcctggtttctgttccctcttcaatggtgtgttcccagccaggtcctgaccctcagagccaagtccctgtcacgtctggggcagccaaaccctcgccccacagggacctggacacgcccggccaggatgtggggttggatgggccattttctgtcctatccctcatctccacccccgccacagcctacacgcatcccacacatgcaggcacacacagcctgtgcacacatgtgttcttggcccggtttcatccccccatgactggtgtctgtgaggtgcagatggacacagcgcacacccagaccctccaccaggctgtgacctcgctgcctctgaggccttgacaaggcccctcaatcggaggacagccggccgtgcacactttcatcatcgtcggacaaacagcgtctactgcacatttttcttattcctattcttgagccatagctatggcatattcttctactattcctattataccacttaccagcttactcg

SEQ ID NO: 16373 - DNA, 4141 bp, Homo sapiens
agcagcgagtccttgcctcccggcggctcaggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacaggtttggatcctgccgggcccatgtttgaaggggccgacatccacaagaggctctctccggacgatgcagattttgtggatgtcctccacacctacacgcgttccttcggcttgagcattggtattcagatgcctgtgggccacattgacatctaccccaatgggggtgacttccagccaggctgtggactcaacgatgtcttgggatcaattgcatatggaacaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagagtttaccattatcagatgaaaatccatgtcttcagttacaagaacatgggagaaattgagcccaccttttacgtcaccctttatggcactaatgcagattcccagactctgccactggaaatagtggagcggatcgagcagaatgccaccaacaccttcctggtctacaccgaggaggacttgggagacctcttgaagatccagctcacctgggagggggcctctcagtcttggtacaacctgtggaaggagtttcgcagctacctgtctcaaccccgcaaccccggacgggagctgaatatcaggcgcatccgggtgaagtctggggaaacccagcggaaactgacattttgtacagaagaccctgagaacaccagcatatccccaggccgggagctctggtttcgcaagtgtcgggatggctggaggatgaaaaacgaaaccagtcccactgtggagcttccctgagggtgcccgggcaagtcttgccagcaaggcagcaagacttcctgctatccaagcccatggaggaaagttactgctgaggacccacccaatggaaggattcttctcagccttgaccctggagcactgggaacaactggtctcctgtgatggctgggactcctcgcgggaggggactgcgctgctatagctcttgctgcctctcttgaatagctctaactccaaacctctgtccacacctccagagcaccaagtccagatttgtgtgtaagcagctgggtgcctggggcctctcgtgcacactggattggtttctcagttgctgggcgagcctgtactctgcctgacgaggaacgctggctccgaagaggccctgtgtagaaggctgtcagctgctcagcctgctttgagcctcagtgagaagtccttccgacaggagctgactcatgtcaggatggcaggcctggtatcttgctcgggccctagctgttggggttctcatgggttgcactgaccatactgcttacgtcttagccattccgtcctgctccccagctcactctctgaagcacacatcattggctttcctatttttctgttcattttttaattgagcaaatgtctattgaacacttaaaattaattagaatgtggtaatggacatattactgagcctctccatttggaacccagtggagttgggatttctagaccctctttctgtttggatggtgtatgtgtatatgcatggggaaaggcacctggggcctgggggaggctataggatataagcattagggaccctgaggctttaagtggtttctatttcttcttagttattatgtgccaccttcttagttattatgtgccacctcccctatgagtgacgtgtttgatcactagcagaatagcaagcagagtatcattcatgctggggccagaatgatggccggttgccagatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagtagggggagaagggcaactattattatccctattttacaaaactgaggcttagtgaggttcagccacatgcctagacttatatactagttagtggtgcagccagggagaggactcagatttcctggaggcaaagtctatctctgaaactccatgaagacttttgcagccagttcccaccaatatgccccagacgtgagacaaacaaggacttttttttttatatagagccatccataaaatcctaagcccttttattaatgtataaccaggagaacatctgtgccaacggttggactttttatggctgagattcgggaggaagtgtgacaccaagcaggagaggaagaatgattttctttgtacttaggttttctaaggacattgttttaatctgtatcgtgccaaagttgtatcactgttaaacttctgaagacataaccagttgagtcttatttcaagatatgttctcaagccaattgtgtgcttctcttgtttctgtgattgctttctagccaaagcgaagcttgtacaggttgagtatcccttatccaaaatgcttggaaccagaagtgtttcaaattttagattattttcagattttggaatgtttgcatatacataatgagatattttgggaataggacccgagcctaaacacaaaattcattgatgtgtcagttacaccttatccacatagcctgagggtaattttatacgatattttaaatagttgtgtacatgaagcatggtttgtggtaacttatgtgaggggttttcccattttttgtcttgttggtgctcaaaaagttttggattttggagcatttcggattttggatttttggattagggttgctcaacccatattattggctgtacatcctggtcacttctgacttctgtttttactaatggaagctttgcaaattgaattctcagtgagttgtatatttatacacctggcttgaagccttaattgtatataatgatgctttttaaaaaatgctatttggaagactatttatttctcgtgtatataatgtatataaaaaaatatggttagtgtttacctaaggttaaccaatttcaagattaaaatttttaaatagtaaaataataaaaaattataaagttcttaa

SEQ ID NO: 16374 - DNA, 1760 bp, Homo sapiens
agcgagtccttgcctcccggcggctcaggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacagcaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagagtttaccattatcagatgaaaatccatgtcttcagttacaagaacatgggagaaattgagcccaccttttacgtcaccctttatggcactaatgcagattcccagactctgccactggaaatagtggagcggatcgagcagaatgccaccaacaccttcctggtctacaccgaggaggacttgggagacctcttgaagatccagctcacctgggagggggcctctcagtcttggtacaacctgtggaaggagtttcgcagctacctgtctcaaccccgcaaccccggacgggagctgaatatcaggcgcatccgggtgaagtctggggaaacccagcggaaactgacattttgtacagaagaccctgagaacaccagcatatccccaggccgggagctctggtttcgcaagtgtcgggatggctggaggatgaaaaacgaaaccagtcccactgtggagcttccctgagggtgcccgggcaagtcttgccagcaaggcagcaagacttcctgctatccaagcccatggaggaaagttactgctgaggacccacccaatggaaggattcttctcagccttgaccctggagcactgggaacaactggtctcctgtgatggctgggactcctcgcgggaggggactgcgctgctatagctcttgctgcctctcttgaatagctctaactccaaacctctgt

SEQ ID NO: 16375 - DNA, 1484 bp, Homo sapiens
agagactatgagggttcactatctgtttgctggaagatatacaagacttttgaggataatacttaaatgaagatagaccggatgtataatatgctttttcttagctttcctatgactctacttagcaacttttgctaaaagaaacacaatatatgactgactactttgaagacacatatattggacacttaaaatcaacaaaagcagagaggtcccaaacgtggtatcttttcacaatgatgtattttatccgaattcttggaattactcatggtgtctttcaaaattaaagatctgtgaaacctgaagcagatatgaatattagccagattatttcctactggggctaccctgatgaagaatatgatattgtaaccgaagatggttatatccttggcctttatagaattccttattggaggacagacaataataaaaatctagctcagagggttgttgtatacttgcaacatggtttgcttacatctgccagcagctggatttccaatcttcccaacaatagtctgggcttcattctggcagatgctggttatgatgtgtggatgggaaatagcagaggaaatacctggtccaggaaacacttgtacctagaaacgagttccaaagaattctgggctttcagttttgatgagatggcaaaatatgaccttccagcctctattgatttcactgtgaagcaaaccagacaagaggaaatattttatgtaggccattcacagggtactactattggtttcataacattttctactatatcaaagatagctgaaagaatcaaaatattttttgctttagcaccagttttttccacaaagtacttaaaaagtcctttaattagaatgacatacaaatggaagtcaatagtcatggctttttcaggcaacaaagacttcttgcctaaaacctcatttaaaaaattcattggttcaaagctgtgtccactacagatttttgataagatttgcctcaatatcttgtttatgatgtttggatatgacccaaaaaacttaaatatgagtcgtttggatgtgtatttttcacacaacccagcaggaacatctgttcaaaatatgcttcattggagtcagcttttaaattctactcatttgaaagcttatgactggggcagtcctgatctgaacttggttcattataatcagacaacgtctccattatacaacatgacaaacatgaatgtggcaactgcaatttggaatggtaaaagtgacttgttggctgaccctgaagacgttaacattttacattctgaaatcacaaaccacatttattataaaactatttcttactacaatcatatagactctttgtttggattagatgtctatgatcaagtttaccatgaaatcattgatattatccaagacaatctataaagaaccatggcgctgtgtgtttaaagatctacatcattcctaatgaaatccaattcttattttttttta

SEQ ID NO: 16376 - DNA, 1230 bp, Homo sapiens
atgtggcagcttttagcagcagcatgctggatgcttcttcttggatctatgtatggttatgacaagaaaggaaacaatgcaaaccctgaagctaatatgaatattagccagattatttcttactggggttatccttatgaagagtatgatgttacaacaaaagatggttatatccttggaatttataggattccacatggaagaggatgcccagggaggacagctccaaagcctgctgtgtatttgcagcatggcttaattgcatctgccagtaactggatttgcaacctgcccaacaacagtttggctttccttctggcagatagtggttatgacgtgtggttggggaacagccgaggaaacacttggtccagaaaacaccttaaattgtcaccgaaatcaccggaatactgggccttcagtttggatgagatggctaaatatgaccttccagccacaatcaattttatcatagagaaaactggacagaagcgactctactacgtgggccactcacaaggcaccaccatagcttttatagcattttctacaaacccagaactggctaaaaagattaagatattttttgcactggctccagttgtcacagttaaatacacccaaagtcctatgaaaaaactaacaaccctttccaggcgagtagttaaggtgttgtttggtgacaaaatgttccaccctcatacattgtttgaccaattcattgccaccaaagtgtgcaatcgaaagctattccgtcgtatttgcagcaacttcctatttactctgagtggatttgatccgcaaaacttaaatatgagtcgcttggatgtttatttgtcacacaatcctgcgggaacatctgttcagaatatgctgcactgggctcaggctgttaattctggtcagctccaagcttttgattggggaaactctgatcagaacatgatgcacttccatcagcttacacctcctttatacaacattactaagatggaagttccaacagcaatatggaatggtggacaggacattgtggctgatcccaaggatgttgaaaatttacttcctcaaattgctaaccttatttattacaagctgattccacactacaatcatgtggatttttaccttggagaggatgcacctcaggaaatttaccaagacctaattatattgatggaagaatatttacaaaattaaatgcactttactttctctaagcaagtggat

SEQ ID NO: 16377 - DNA, 1272 bp, Homo sapiens
atgttggaaaccttgtcaagacagtggattgtctcacacagaatggaaatgtggcttctgattctggtggcgtatatgttccagagaaatgtgaattcagtacatatgccaactaaagctgtggacccagaagcattcatgaatattagtgaaatcatccaacatcaaggctatccctgtgaggaatatgaagtcgcaactgaagatgggtatatcctttctgttaacaggattcctcgaggcctagtgcaacctaagaagacaggttccaggcctgtggtgttactgcagcatggcctagttggaggtgctagcaactggatttccaacctgcccaacaatagcctgggcttcattctggcagatgctggttttgacgtgtggatggggaacagcaggggaaacgcctggtctcgaaaacacaagacactctccatagaccaagatgagttctgggctttcagttatgatgagatggctaggtttgaccttcctgcagtgataaactttattttgcagaaaacgggccaggaaaagatctattatgtcggctattcacagggcaccaccatgggctttattgcattttccaccatgccagagctggctcagaaaatcaaaatgtattttgctttagcacccatagccactgttaagcatgcaaaaagccccgggaccaaatttttgttgctgccagatatgatgatcaagggattgtttggcaaaaaagaatttctgtatcagaccagatttctcagacaacttgttatttacctttgtggccaggtgattcttgatcagatttgtagtaatatcatgttacttctgggtggattcaacaccaacaatatgaacatgagccgagcaagtgtatatgctgcccacactcttgctggaacatctgtgcaaaatattctacactggagccaggcagtgaattctggtgaactccgggcatttgactgggggagtgagaccaaaaatctggaaaaatgcaatcagccaactcctgtaaggtacagagtcagagatatgacggtccctacagcaatgtggacaggaggtcaggactggctttcaaatccagaagacgtgaaaatgctgctctctgaggtgaccaacctcatctaccataagaatattcctgaatgggctcacgtggatttcatctggggtttggatgctcctcaccgtatgtacaatgaaatcatccatctgatgcagcaggaggagaccaacctttcccagggacggtgtgaggccgtattgtga

SEQ ID NO: 16378 - DNA, 1452 bp, Homo sapiens
tggcttctgattctggtggcgtatatgttccagagaaatgtgaattcagtacatatgccaactaaagctgtggacccagaagcattcatgaatattgagaatcatcatcatcgcctgtggaaaggaagtagagaatcaggagtaaggaaagagataaatcaaactgtgatacagacttcaaaacagccagactcaactccatgaggagctatggagctaaaactgctcttcagagatgtcctacgttgggctgagatgaccaggcctttagaccgcaaacagagtgaaatcatccaacatcaaggctatccctgtgaggaatatgaagtcgcaactgaagatgggtatatcctttctgttaacaggattcctcgaggcctagtgcaacctaagaagacaggttccaggcctgtggtgttactgcagcatggcctagttggaggtgctagcaactggatttccaacctgcccaacaatagcctgggcttcattctggcagatgctggttttgacgtgtggatggggaacagcaggggaaacgcctggtctcgaaaacacaagacactctccatagaccaagatgagttctgggctttcagttatgatgagatggctaggtttgaccttcctgcagtgataaactttattttgcagaaaacgggccaggaaaagatctattatgtcggctattcacagggcaccaccatgggctttattgcattttccaccatgccagagctggctcagaaaatcaaaatgtattttgctttagcacccatagccactgttaagcatgcaaaaagccccgggaccaaatttttgttgctgccagatatgatgatcaagggattgtttggcaaaaaagaatttctgtatcagaccagatttctcagacaacttgttatttacctttgtggccaggtgattcttgatcagatttgtagtaatatcatgttacttctgggtggattcaacaccaacaatatgaacatgagccgagcaagtgtatatgctgcccacactcttgctggaacatctgtgcaaaatattctacactggagccaggcagtgaattctggtgaactccgggcatttgactgggggagtgagaccaaaaatctggaaaaatgcaatcagccaactcctgtaaggtacagagtcagagatatgacggtccctacagcaatgtggacaggaggtcaggactggctttcaaatccagaagacgtgaaaatgctgctctctgaggtgaccaacctcatctaccataagaatattcctgaatgggctcacgtggatttcatctggggtttggatgctcctcaccgtatgtacaatgaaatcatccatctgatgcagcaggaggagaccaacctttcccagggacggtgtgaggccgtattgtgaagcatctgacactgacgatcttaggacaacctcctgagggatggg

SEQ ID NO: 16379 - DNA, 1197 bp, Homo sapiens
atgatgtggctgcttttaacaacaacttgtttgatctgtggaactttaaatgctggtggattccttgatttggaaaatgaagtgaatcctgaggtgtggatgaatactagtgaaatcatcatctacaatggctaccccagtgaagagtatgaagtcaccactgaagatgggtatatactccttgtcaacagaattccttatgggcgaacacatgctaggagcacaggtccccggccagttgtgtatatgcagcatgccctgtttgcagacaatgcctactggcttgagaattatgctaatggaagccttggattccttctagcagatgcaggttatgatgtatggatgggaaacagtcggggaaacacttggtcaagaagacacaaaacactctcagagacagatgagaaattctgggcctttagttttgatgaaatggccaaatatgatctcccaggagtaatagacttcattgtaaataaaactggtcaggagaaattgtatttcattggacattcacttggcactacaatagggtttgtagccttttccaccatgcctgaactggcacaaagaatcaaaatgaattttgccttgggtcctacgatctcattcaaatatcccacgggcatttttaccaggttttttctacttccaaattccataatcaaggctgtttttggtaccaaaggtttctttttagaagataagaaaacgaagatagcttctaccaaaatctgcaacaataagatactctggttgatatgtagcgaatttatgtccttatgggctggatccaacaagaaaaatatgaatcagagtcgaatggatgtgtatatgtcacatgctcccactggttcatcagtacacaacattctgcatataaaacagctttaccactctgatgaattcagagcttatgactggggaaatgacgctgataatatgaaacattacaatcagagtcatccccctatatatgacctgactgccatgaaagtgcctactgctatttgggctggtggacatgatgtcctcgtaacaccccaggatgtggccaggatactccctcaaatcaagagtcttcattactttaagctattgccagattggaaccactttgattttgtctggggcctcgatgcccctcaacggatgtacagtgaaatcatagctttaatgaaggcatattcctaa

SEQ ID NO: 16380 - DNA, 1782 bp, Homo sapiens
ttttattctcaaaatgtgtcaggataagaagcacttctgtaaatcgacctttttaaaatagatataattagatttgcagttgggggcagtaaagaaagggtctgaacagtggataacatgttgagaggttaattattaatgggcagtcttccctaacaaagtatctaataggcattgtggtctctttggcttcagaaattaccaagaaagcctggaccccgggtgaaacggagaaatggacacaagtcccctgtgtttctccattctgttggttttatgcatctttatccaatcaagtgcccttggacaaagcctgaaaccagagccatttggaagaagagctcaagctgttgaaacaaacaaaacgctgcatgagatgaagaccagattcctgctctttggagaaaccaatcagggctgtcagattcgaatcaatcatccggacacgttacaggagtgcggcttcaactcctccctgcctctggtgatgataatccacgggtggtcggtggacggcgtgctagaaaactggatctggcagatggtggccgcgctgaagtctcagccggcccagccagtgaacgtggggctggtggactggatcaccctggcccacgaccactacaccatcgccgtccgcaacacccgccttgtgggcaaggaggtcgcggctcttctccggtggctggaggaatctgtgcaactctctcgaagccatgttcacctaattgggtacagcctgggtgcacacgtgtcaggatttgccggcagttccatcggtggaacgcacaagattgggagaatcacagggctggatgccgcgggacctttgtttgagggaagtgcccccagcaatcgtctttctccagatgatgccaattttgtggatgccattcatacctttacccgggagcacatgggcctgagcgtgggcatcaaacagcccataggacactatgacttctatcccaacgggggctccttccagcctggctgccacttcctagagctctacagacatattgcccagcacggcttcaatgccatcacccagaccataaaatgctcccacgagcgatcggtgcaccttttcatcgactccttgctgcacgccggcacgcagagcatggcctacccgtgtggtgacatgaacagcttcagccagggcctgtgcctgagctgcaagaagggccgctgcaacacgctgggctaccacgtccgccaggagccgcggagcaagagcaagaggctcttcctcgtaacgcgagcccagtcccccttcaaagtttatcattaccagttcaagatccagttcatcaaccaaactgagacaccaatacaaacaacttttaccatgtcactactcggaacaaaagagaaaatgcagaaaattcccatcactctgggcaaaggaattgctagtaataaaacgtattcctttcttatcacgctggatgtggatatcggcgagctgatcatgatcaagttcaagtgggaaaacagtgcagtgtgggccaatgtctgggacacggtccagaccatcatcccatggagcacagggccgcgccactcaggcctcgttctgaagacgatcagagtcaaagcaggagaaacccagcaaagaatgacattttgttcagaaaacacagatgacctactacttcgcccaacccaggaaaaaatcttcgtgaaatgtgaaataaagtctaaaacatcaaagcgaaagatcagatgagatttaatgaagacccagtgtaaagaataaatgaatcttactcctta

SEQ ID NO: 16381 - DNA, 2161 bp, Homo sapiens
gatgagaattgccaaggcacagcaaagcctgcagcttccatacccgtcatgagagcaaataacttatttgtaaacctaagcacttaattaactaaatggaaagcaaggcagtgagtgattcctgacatggccgaatttaagtcaagctgtgaagctccaggtgcagccagaaatggagatggacaacttgaactgaaccctgagagcttctaaaaaggctttggaccactgcttctcagcagtttttcttacggagtctctctgtgtcgcccaggctggagtacaatggcgcgatctcagttcactgcaacctccgcctcccaggttcaagcgattctcctgcctcagcttcctgagtagctgggattacaggcactcacctccacgcccagctaacttttgtatttttagtacagatggggtttcaccatgttggtcaggctggtctcgaactcctgacctcgtgatccgccctcctcgcctcccaaagtgctgtgattacaggagtgagccaccgctcctggccagaaatctcttctttattatgtctactgtccgttatccaactccagaagaaattaccaagaaagcctggaccccgggtgaaacggagaaatggacacaagtcccctgtgtttctccattctgttggttttatgcatctttatccaatcaagtgcccttggacaaagcctgaaaccagagccatttggaagaagagctcaagctgttgaaacaaacaaaacgctgcatgagatgaagaccagattcctgctctttggagaaaccaatcagggctgtcagattcgaatcaatcatccggacacgttacaggagtgcggcttcaactcctccctgcctctggtgatgataatccacgggtggtcggtggacggcgtgctagaaaactggatctggcagatggtggccgcgctgaagtctcagccggcccagccagtgaacgtggggctggtggactggatcaccctggcccacgaccactacaccatcgccgtccgcaacacccgccttgtgggcaaggaggtcgcggctcttctccggtggctggaggaatctgtgcaactctctcgaagccatgttcacctaattgggtacagcctgggtgcacacgtgtcaggatttgccggcagttccatcggtggaacgcacaagattgggagaatcacagggctggatgccgcgggacctttgtttgagggaagtgcccccagcaatcgtctttctccagatgatgccaattttgtggatgccattcatacctttacccgggagcacatgggcctgagcgtgggcatcaaacagcccataggacactatgacttctatcccaacgggggctccttccagcctggctgccacttcctagagctctacagacatattgcccagcacggcttcaatgccatcacccagaccataaaatgctcccacgagcgatcggtgcaccttttcatcgactccttgctgcacgccggcacgcagagcatggcctacccgtgtggtgacatgaacagcttcagccagggcctgtgcctgagctgcaagaagggccgctgcaacacgctgggctaccacgtccgccaggagccgcggagcaagagcaagaggctcttcctcgtaacgcgagcccagtcccccttcaaagtttatcattaccagttcaagatccagttcatcaaccaaactgagacaccaatacaaacaacttttaccatgtcactactcggaacaaaagagaaaatgcagaaaattcccatcactctgggcaaaggaattgctagtaataaaacgtattcctttcttatcacgctggatgtggatatcggcgagctgatcatgatcaagttcaagtgggaaaacagtgcagtgtgggccaatgtctgggacacggtccagaccatcatcccatggagcacagggccgcgccactcaggcctcgttctgaagacgatcagagtcaaagcaggagaaacccagcaaagaatgacattttgttcagaaaacacagatgacctactacttcgcccaacccaggaaaaaatcttcgtgaaatgtgaaataaagtctaaaacatcaaagcgaaagatcagatgagatttaatgaagacccagtgtaaagaataaatgaatcttactcctt

SEQ ID NO: 16382 - DNA, 3806 bp, Homo sapiens
cttcttgtaagagagtgctaggcacatagcctcctcctattcctaatcctcccaccaaagaaagaggcacagagttcattacttagtgggggccagctgtgatcggccaactgccagctgccttaaaaaggaagaccagtgatgctaggatggagtgaaacccaagaggaagtgccatcatgaggaatcaatgagagatctgtgaagagagagggctgggtgggagcccagaaggatagaacctggaagatcaatatctcccgtgagggaaataacaatggagccaggttctaagtcagtgtctaggtcagactggcaacctgaaccacaccagaggcctataaccccgctagagcctgggccagaaaagacacccatagcccagccagaatcgaagactctgcagggatccaatacccaacagaagcctgcttcaaaccaaagacccctcacccagcaggagacccctgcacaacatgatgctgaatcccagaaggaacctagagcccaacaaaaatctgcttcacaagaggaatttcttgccccacagaagcccgcaccacagcaatcaccttacatccaaagggtgctgctcactcaacaggaagctgcctcccagcagggacctgggctaggaaaagaatctataactcaacaggagccagcattgagacaaagacatgtagcccagccagggcctgggccaggagagccacctccagctcaacaagaagctgaatcaacacctgcggcccaggctaaacctggagccaaaagggagccatctgccccgactgaatctacgtcccaagagacacctgaacagtcagacaagcaaacaacgccagtccagggagccaaatccaagcagggatctttgacagagctgggatttctaacaaaacttcaggaactatccatacagcgatcagccctagagtggaaggcactttctgagtgggtcacagattctgagtcagaatcagatgtgggatcatcttcagacacagattctccagccacgatgggtggaatggtggcccagggagtgaagctaggcttcaaaggaaaatctggttataaagtgatgtcaggatacagtgggacgtcgccacatgagaaaaccagtgctcggaatcacagacactaccaggatacagcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccagttcacgcctgccatccggccattcctgcagaccatctccattgggctggtgtccttcggggagcactacaaacgcaacgagacaggcctcagtgtggccgccagctctctcttcaccagcggccgctttgccatcgaccccgagctgcgtggggctgagtttgagcggatcacacagaacctggacgtgcacttctggaaagccttctggaacatcaccgagatggaagtgctatcgtctctggccaacatggcatcggccaccgtgagggtaagccgcctgctcagcctgccacccgaagcctttgagatgccactgactgccgaccccacgctcacggtcaccatctcacccccactggcccacacaggccctgggcccgtcctcgtcaggctcatctcctatgacctgcgtgaaggacaggacagtgaggagctcagcagcctgataaagtccaacggccaacggagcctggagctgtggccgcgcccccagcaggcaccccgctcgcggtccctgatagtgcacttccacggcggtggctttgtggcccagacctccagatcccacgagccctacctcaagagctgggcccaggagctgggcgcccccatcatctccatcgactactccctggcccctgaggcccccttcccccgtgcgctggaggagtgcttcttcgcctactgctgggccatcaagcactgcgccctccttggctcaacaggggaacgaatctgccttgcgggggacagtgcaggcgggaacctctgcttcaccgtggctcttcgggcagcagcctacggggtgcgggtgccagatggcatcatggcagcctacccggccacaatgctgcagcctgccgcctctccctcccgcctgctgagcctcatggaccccttgctgcccctcagtgtgctctccaagtgtgtcagcgcctatgctggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcagagccgatgcgccgcagtgtgtctgaagcagcactggcccagccccagggcccactgggcacggattccctcaagaacctgaccctgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgagggtttccacccccgacgctccagccagggtgccacacagatgcccctctactcctcacccatagtcaagaaccccttcatgtcgccgctgctggcacccgacagcatgctcaagagcctgccacctgtgcacatcgtggcgtgcgcgctggaccccatgctggacgactcggtcatgctcgcgcggcgactgcgcaacctgggccagccggtgacgctgcgcgtggtggaggacctgccgcacggcttcctgaccctagcggcgctgtgccgcgagacgcgccaggccgcagagctgtgcgtggagcgcatccgcctcgtcctcactcctcccgccggagccgggccgagcggggagacgggggctgcgggggtagacgggggctgcggggggcgacactaaaagcctgttgttcccatctgcgccggcctccgtcatgaatgccttccgggccgggcggaaggggacgcgggctgtgccttacttaagtcgggggtggcaagggggcggggcgggggcccgaaagctgagaccctcgccacggggagggggacgcgcacacacaccggtcaccgagacggctggacctgcacgccaccgctgccttttgctgctgctgctgcggcgaccgccgcagggacggggactggccctcccttgcaggtcggtttggtttgttgtaaataaaagtatttaatta

SEQ ID NO: 16383 - DNA, 4026 bp, Homo sapiens
agtccctagggaacttcctgttgtcaccacacctctgagtcgtctgagctcactgtgagcaaaatcccacagtggaaactcttaagcctctgcgaagtaaatcattcttgtgaatgtgacacacgatctctccagtttccatatgttgagattctacttattcatcagtttgttgtgcttgtcaagatcagacgcagaagaaacatgtccttcattcaccaggctgagctttcacagtgcagtggttggtacgggactaaatgtgaggctgatgctctacacaaggaaaaacctgacctgcgcacaaaccatcaactcctcagcttttgggaacttgaatgtgaccaagaaaaccaccttcattgtccatggattcaggccaacaggctcccctcctgtttggatggatgacttagtaaagggtttgctctctgttgaagacatgaacgtagttgttgttgattggaatcgaggagctacaactttaatatatacccatgcctctagtaagaccagaaaagtagccatggtcttgaaggaatttattgaccagatgttggcagaaggagcttctcttgatgacatttacatgatcggagtaagtctaggagcccacatatctgggtttgttggagagatgtacgatggatggctggggagaattacaggcctcgaccctgcaggccctttattcaacgggaaacctcaccaagacagattagatcccagtgatgcgcagtttgttgatgtcatccattccgacactgatgcactgggctacaaggagccattaggaaacatagacttctacccaaatggaggattggatcaacctggctgccccaaaacaatattgggaggatttcagtattttaaatgtgaccaccagaggtctgtatacctgtacctgtcttccctgagagagagctgcaccatcactgcgtatccctgtgactcctaccaggattataggaatggcaagtgtgtcagctgcggcacgtcacaaaaagagtcctgtccccttctgggctattatgctgataattggaaagaccatctaagggggaaagatcctccaatgacgaaggcattctttgacacagctgaggagagcccattctgcatgtatcattactttgtggatattataacatggaacaagaatgtaagaagaggggacattaccatcaaattgagagacaaagctggaaacaccacagaatccaaaatcaatcatgaacccaccacatttcagaaatatcaccaagtgagtctacttgcaagatttaatcaagatctggataaagtggctgcaatttccttgatgttctctacaggatctctaataggcccaaggtacaagctcaggattctccgaatgaagttaaggtcccttgcccatccggagaggcctcagctgtgtcggtatgatcttgtcctgatggaaaacgttgaaacagtcttccaacctattctttgcccagagttgcagttgtaactgttgccaggacacatggccataaataatagaaagaaagctacaaccacaggctgtttgaaagcttcacctcacctttctgcaaggcagaaaaagtatgaaaaaaaccaaggcttttttcagtagcgtcctatggatgtcacattgtacatcaaacaaccttgtgattataaaacgatcctgggaaggagcccctaactagggcaagtcagaaatagccaggctcgcagcagcgcagcgctgtgtctgctgtgtcctggggcctcccttgttccgacctgtcaattctgctgcctgtcacgcgggtggttctgcccatcgcggctgcgggtcaagcatcttcaagggaaggacggactggaggcctcaccgtggactcaactctgcattctccgtgccacattcctccagttcccacacgtagaagggaacgaaactgacgtctacctcatggggctgctgtgtgggtttgggaggcaaaaatctatgaagggttttttgaaatcccataggtgccacatctatgagatgtttgataaatgtgaatatgcttttacatttgggcttatctaatttgcaataagagagcctctctctatcaacaccagcttctctctcgggctgtttgctcagggaaggcaagaaagccacgtgctggccctctgccttctctaaagtgctgttggagcatggaggagctggaggagatggggatggactgacagctaagagggcggctgctgggactagatagtggatgaagaaagaaggacgaggaagccgtggggcagcctcttcacatggggacaggggatggagcatgaggcaagggaaggaaaagcagagcttatttttcacctaaggtggagaaggatcactttacaggcaacgctcattttaagcaacccttaagaaatgtttatgtttctttattaccaatgtaatctatgattattgaaggaaatttagaaaatgcgtagatacaaaattaaaaaaaaatactgtccacgatcctattagaggtaattaatgttagccttttggaacaaggctgtcacctattttgccaacacgtgaattcaaaacatgaaccggtttgcttttggagaatctgaagactccagtttgaggaatcctttgcttccctggaggtagatgctgtctgcaaatctagaatgacagcaggagtccagtcaagaggtcctgtcaggccaaggccagaaagaagggaggacaatccctggggccagatgcccagtgtgaggggaggcatgatctgtcccatggctgtggccactgcaggaaggtctgtgaaaaggaggtgacaggcccagtcacctcctcttcacccaagtgattgctccttcaactgctatctgtgaaaatagcctttgttatgaagaaattgactctctctctctttttttttttttggagttgcctaggctggagtgcaatggtacgatctcagctcactgcaacctccacctcccaggttcaattgattctcctgcctcagcctcctgagtagctgggattacaggcatgtgccaccacacccggctaatttttgtatttttattagagacagggtttcaccacgttagccaggctcgtctcgaactcctgtcctcaggtgactacccgtctcggcctcccaaagtgctgggattacaggcatgagccaccacacccggccaaaaatggattctctatgtcataaattaaagaaatctataaatgtattcctgtgtggcacatcttcttacagatttacatttgcagcaaatacagagtctgttttatttaagtgagggatgactgaactctgagtggaacaagctcttggacatgttaccatccttcctcctccttctcacatttcctcagcaattgtggatagagagatcagtgtgctgtaggccctggttttttttttttttttttttttttttttttagatggagtctccttctgttacccaggctggagtgcagtggcacgatcttggctcactgcaacctctgcctcccgggttcaagcaattctctgcctcagcctcccaagtagctgggattacaggcgcccccaccatgcctggctaatttttgtatttttagtagagacctggtttcaccatcttggccttgaactcctgaccttgtgatccactggccttggcctctcaaagttctgggattacaggtgtgagccatcgtacccggcagccctggtttcttcttagttttattggtctgtgttttgatcagcacagtcacttttttgttctctttcctggtaagcagggagtcaaaacaatagcaagaaaatgccagaaatagaatttctactactttgtaaactctaggctcgtgggtctcctagctctcagtacctggctcactgtaggatgggtagatgggtgaatgaatggataaagaaaggaagtttgttcaccggagaggagatgaatttcagtaagtttcatgtaacagtgatcaggagaaataaaggcagttataactgtg

SEQ ID NO: 16384 - DNA, 1652 bp, Homo sapiens
agtgaacttctgatagggtcttatttatgttgctcaaatgtttacataataacttgtgccaaaaatatagtgctcatgcttttcagttctcacccagaaatgtcctgtggcttctagttgtgtgcctgagatcagataataaaagaccatgccttgaattctctcagctaagtgtaaaggattccttcagagatttatttattccgagaatagagaccattctgatgatgtatacaaggaacaacctaaactgtgctgagccactgtttgaacaaaataactcacttaatgttaatttcaacacacaaaagaaaacagtctggcttattcacggatacagaccagtaggctccatcccattatggcttcagaacttcgtaaggattttgctgaatgaagaagatatgaatgtaattgtagtagactggagccggggtgctacaacttttatttataatagagcagttaaaaacaccagaaaagttgctgtgagtttgagtgtgcacattaaaaatcttttgaagcatggtgcatctcttgacaattttcatttcataggtgtgagcttaggggctcatatcagtggatttgttggaaagatatttcatggtcaacttggaagaataacaggtcttgaccctgctgggccaaggttctccagaaaaccaccatatagcagattagattacacggatgcaaagtttgtggatgtcatccattctgactccaatggtttaggcattcaagagcccttgggacatatagatttttatccaaatggaggaaataaacaacctggctgtcctaaatcaattttctcaggaattcaattcattaaatgcaaccaccagagagcagttcacttgttcatggcatctttagaaacaaactgcaattttatttcatttccttgtcgttcatacaaagattacaagactagcttatgtgtggactgtgactgttttaaggaaaaatcatgtcctcggctgggttatcaagccaagctatttaaaggtgttttaaaagaaaggatggaaggaagacctcttaggaccactgtgtttttggatacaagtggtacatatccattctgtacctattattttgttctcagtataattgttccagataaaactatgatggatggctcgttttcatttaaattattaaatcagcttggaatgattgaagagccaaggctttatgaaaagaacaaaccattttataaacttcaagaagtcaagattcttgctcaattttataatgactttgtaaatatttcaagcattggtttgacatatttccagagctcaaatctgcagtgttccacatgcacatacaagatccagagactcatgttaaaatcacttacatacccagaaagaccaccactttgcaggtataatattgtacttaaagacagagaggaagtgtttcttaatccaaacacatgtacaccaaagaacacataagatgccttcttccatcaaatgcacttgcttgtgaattaatggacttgtaaatgaaacaatgcaatcagtcttttataatgcactgttcaatttgagattcaagtatttctatttcttggaaaaaattttaagaatcaaaaataaagaaaataaaaaatgcatacagttaaacattccaaa

SEQ ID NO: 16385 - DNA, 1546 bp, Homo sapiens
ggtcttatttatgttgctcaaatgtttacataataacttgtgccaaaaatatagtgctcatgcttttcagttctcacccagaaatgtcctgtggcttctagttgtgtgcctgagatcagataataaaagaccatgccttgaattctctcagctaagtgtaaaggattccttcagagatttatttattccgagaatagagaccattctgatgatgtatacaaggaacaacctaaactgtgctgagccactgtttgaacaaaataactcacttaatgttaatttcaacacacaaaagaaaacagtctggcttattcacggatacagaccagtaggctccatcccattatggcttcagaacttcgtaaggattttgctgaatgaagaagatatgaatgtaattgtagtagactggagccggggtgctacaacttttatttataatagagcagttaaaaacaccagaaaagttgctgtgagtttgagtgtgcacattaaaaatcttttgaagcatggtgcatctcttgacaattttcatttcataggtgtgagcttaggggctcatatcagtggatttgttggaaagatatttcatggtcaacttggaagaataacaggtcttgaccctgctgggccaaggttctccagaaaaccaccatatagcagattagattacacggatgcaaagtttgtggatgtcatccattctgactccaatggaattcaattcattaaatgcaaccaccagagagcagttcacttgttcatggcatctttagaaacaaactgcaattttatttcatttccttgtcgttcatacaaagattacaagactagcttatgtgtggactgtgactgttttaaggaaaaatcatgtcctcggctgggttatcaagccaagctatttaaaggtgttttaaaagaaaggatggaaggaagacctcttaggaccactgtgtttttggatacaagtggtacatatccattctgtacctattattttgttctcagtataattgttccagataaaactatgatggatggctcgttttcatttaaattattaaatcagcttggaatgattgaagagccaaggctttatgaaaagaacaaaccattttataaacttcaagaagtcaagattcttgctcaattttataatgactttgtaaatatttcaagcattggtttgacatatttccagagctcaaatctgcagtgttccacatgcacatacaagatccagagactcatgttaaaatcacttacatacccagaaagaccaccactttgcaggtataatattgtacttaaagacagagaggaagtgtttcttaatccaaacacatgtacaccaaagaacacataagatgccttcttccatcaaatgcacttgcttgtgaattaatggacttgtaaatgaaacaatgcaatcagtcttttataatgcactgttcaatttgagattcaagtatttctatttcttggaaaaaattttaagaatcaaaaataaagaaaataaaaaatgcatacagttaaacattccaaa

SEQ ID NO: 16386 - DNA, 421 bp, Homo sapiens
ttataatagagcagttaaaaacaccagaaaagttgctgtgagtttgagtgtgcacattaaaaatcttttgaagcatggtgcatctcttgacaattttcatttcataggtgtgagcttaggggctcatatcagtggatttgttggaaagatatttcatggtcaacttggaagaataacaggtcttgaccctgctgggccaaggttctccagaaaaccaccatatagcagattagattacacggatgcaaagtttgtggatgtcatccattctgactccaatggaattcaattcattaaatgcaaccaccagagagcagttcacttgttcatggcatctttagaaacaaactgcaattttatttcatttccttgtcgttcatacaaagattacaagactagcttatgtgtggactgtgactgt

SEQ ID NO: 16387 - DNA, 1563 bp, Homo sapiens
atgagagtatacatttttctttgtttgatgtgctgggtgagatctgataataaaagaccatgccttgaattctctcagctaagtgtaaaggattccttcagagatttatttattccgagaatagagaccattctgatgatgtatacaaggaacaacctaaactgtgctgagccactgtttgaacaaaataactcacttaatgttaatttcaacacacaaaagaaaacagtctggcttattcacggatacagaccagtaggctccatcccattatggcttcagaacttcgtaaggattttgctgaatgaagaagatatgaatgtaattgtagtagactggagccggggtgctacaacttttatttataatagagcagttaaaaacaccagaaaagttgctgtgagtttgagtgtgcacattaaaaatcttttgaagcatggtgcatctcttgacaattttcatttcataggtgtgagcttaggggctcatatcagtggatttgttggaaagatatttcatggtcaacttggaagaataacaggtcttgaccctgctgggccaaggttctccagaaaaccaccatatagcagattagattacacggatgcaaagtttgtggatgtcatccattctgactccaatggtttaggcattcaagagcccttgggacatatagatttttatccaaatggaggaaataaacaacctggctgtcctaaatcaattttctcaggaattcaattcattaaatgcaaccaccagagagcagttcacttgttcatggcatctttagaaacaaactgcaattttatttcatttccttgtcgttcatacaaagattacaagactagcttatgtgtggactgtgactgttttaaggaaaaatcatgtcctcggctgggttatcaagccaagctatttaaaggtgttttaaaagaaaggatggaaggaagacctcttaggaccactgtgtttttggatacaagtggtacatatccattctgtacctattattttgttctcagtataattgttccagataaaactatgatggatggctcgttttcatttaaattattaaatcagcttggaatgattgaagagccaaggctttatgaaaagaacaaaccattttataaacttcaagaagtcaagattcttgctcaattttataatgactttgtaaatatttcaagcattggtttgacatatttccagagctcaaatctgcagtgttccacatgcacatacaagatccagagactcatgttaaaatcacttacatacccagaaagaccaccactttgcaggtataatattgtacttaaagacagagaggaagtgtttcttaatccaaacacatgtacaccaaagaacacataagatgccttcttccatcaaatgcacttgcttgtgaattaatggacttgtaaatgaaacaatgcaatcagtcttttataatgcactgttcaatttgagattcaagtatttctatttcttggaaaaaattttaagaatcaaaaataaagaaaataaaaaatgcatacagttaaacattccaaa

SEQ ID NO: 16388 - DNA, 5384 bp, Homo sapiens
ccgcccccgaaggcgagctgcgctgacagccggcggcgggctgggtgtttgcaatacaaaggcggccacgcgcggcgccgctcggtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataaatttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagacttctctgaaaa

SEQ ID NO: 16389 - DNA, 4005 bp, Homo sapiens
ctttttggtctgtctgaattccctcagtgacggtcggcagaaagcgcatctgtgtttgtgcacgagacctttggagaagggttgctgtggcctgaacgggcagcatttatggtggtggcctgtttgctgttggggagggacttgcagcagactttctcgtagggctgggctccttatgcgtgagttgcacgcctgagtgcctctatgggttttgtggctcgtggcttttatgaagggaccagaatgttaggaactctggagttgggaattgctgcaggagaaccgtgttccgcatttcgttcttctagagcagagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataaatttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaa

SEQ ID NO: 16390 - DNA, 3233 bp, Homo sapiens
agcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtagcctggtagattgcaaaaggactgcccctcatcttgcagttgcggccgagggaggtctgtctagttcttgccctccacagtcttccctgttccatccttcggaaagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccgga

SEQ ID NO: 16391 - DNA, 1439 bp, Homo sapiens
gatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaagtcttcatgcttaagttaccttcatgtaattttggacgccattaggttttgcttctctaaaatttttaacgcacaaatagccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagaga

SEQ ID NO: 16392 - DNA, 477 bp, Homo sapiens
gcaatacaaaggcggccacgcgcggcgccgctcgtatttgcaaccacgtggcttcacgagtccgccaaaccatcaggtgaataaacgggagaggagaagagagtctaggactcagccctggagtataagtcagagctggaaaagaagaggctccagagactggacggccactgagaggtgccacgtccctgaagggcctgaggagggttgatggcatgaccccatgaagcccagcaaggagtggagagaggagggctggaggactcccgcctgccatgacccagtccagggataagattggcacgatctcagctcactgcagcctccacctcctgggttcaagtgatcttcccacctcagcctcccaagtagctgggactacaggtgcagaccatgaattacgtggggcagttagccggccaggtgtttgtcaccgtgaaggagctctacaaggggctgaatcccgccacactctca

SEQ ID NO: 16393 - DNA, 3051 bp, Homo sapiens
aagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtc

SEQ ID NO: 16394 - DNA, 599 bp, Homo sapiens
gtttgcaatacaaaggcggccacgcgcggcgccgctcgtatttgcaaccacgtggcttcacgagtccgccaaaccatcaggtgaataaacgggagaggagaagagagtctaggactcagccctggagtataagtcagagctggaaaagaagaggctccagagactggacggccactgagaggtgccacgtccctgaagggcctgaggagggttgatggcatgaccccatgaagcccagcaaggagtggagagaggagggctggaggactcccgcctgccatgacccagtccagggataagatgtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcag

SEQ ID NO: 16395 - DNA, 3077 bp, Homo sapiens
atttctctcctgatgctgggtgaggaggcagacagcaccatacagggcgggccatgggggaacaggacggcattcgcagctccagctgggagacctcgcagggcaagagctccccagactcggcttggtcatggattccaataatgagagaccctgggtggattcgaaatgtatggtcttcaaacattaacgtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtagcctggtagattgcaaaaggactgcccctcatcttgcagttgcggccgagggaggtctgtctagttcttgccctccacagtcttccctgttccatccttcggaaagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcct

SEQ ID NO: 16396 - DNA, 1761 bp, Homo sapiens
agcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtagcctggtagattgcaaaaggactgcccctcatcttgcagttgcggccgagggaggtctgtctagttcttgccctccacagtcttccctgttccatccttcggaaagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaagtaaaattcctgttaattcctca

SEQ ID NO: 16397 - DNA, 6229 bp, Homo sapiens
gagaagaagtggcaggtgatgctgaagcgggggagaagcggcagagccggccacacagtgcaggggatggagacaggtgctgggctggtcctcctgcagcatcctcagttgttggagggcagtcatcctcaggccgtacccagccagagaagaaaaagaacagtgtgaagccacgtgtgatagccgtccaacatcggctcttccctccaattacattgtagttgattgtgtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagtgcagtggatcttcacatgaagttgggtgataacggagaagctttctttgttgaggagactgaagaagaatatgaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacgaggatcttcaaatgcttccttgaaagaagaagaatgtaaagagcctttgctcttccattctggggatcattaccccttatctgatggagattggtcccctttagagaccacctatccccagacagcgtgtcctaagagtgattcagagctggaggtgaaacctgcggagagcctgctcagatcagagtctcacatggagtggacgtggggcggattcccagagtccaccaaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaaggtgttcacaaaagaagccaacaccagggacctgatgatatttaccttgatgacttaaagggtctagaacctgaagttgcagctctttatttccctaaaagtgaatcggagcccggttccaggcagtggcccgagtctgacacactctctggctcccagtccccacagtccgtgggaagcgcagctgcagatagcggcaccgagtgcctctcagattctgccatggacttgcctgacgttaccctctccctttgcgggggcctcagtgaaaatggagaaatttcaaaagaaaaattcatggagcatatcattacttatcacgaatttgcagaaaaccctggacttatagacaatcctaaccttgtaataaggatatataatcgttactataactgggctttggcagctcccatgatccttagcttgcaagtattccagaagagcttgcctaaggccacagttgagtcctgggtgaaagacaagatgccaaagaaatctggtcgctggtggttttggcgaaagagagaaagcatgaccaaacagctgccagaatccaaggagggaaaatctgaggcaccgccagccagtgacctgccatccagctccaaggagccggccggtgccaggccggccgagaatgactcctcgagtgacgagggatcacaggagctcgaagaatccatcacagtggaccccatccccacagagcccctgagccacggcagcacaacttcatataagaagtctctccgcctctcctcagaccagatcgcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtcggatgctttgggacagattctcccacagctgggcaaagactggacccaccagggtatagcaaagctctaccattccatcaatgagaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacagagaagtgatagaaaagaaaccagagaagttcaaaattgagtgtctaaatgatatcaagaatctgtttgccccgtctaagcagcccttctatgctgcctttggaaaccgtccaaatgatgtctatgcctacacacaagttggagttccagactgtagaatattcaccgtgaaccccaagggtgaattaatacaagaaagaaccaaaggaaacaagtcatcgtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggcggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgacaactccacgagcccttaatttcttagtcctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccccatggggacacgggtgcctatgtattttcactaaaatatacatggtagctccatttactgatgcggttgtaatgagctcacatcgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaatttcgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaa

SEQ ID NO: 16398 - DNA, 936 bp, Homo sapiens
agctgccggctcggccgccgcagccgcggcgtcccattcatgagggccgcccgactcagctgcggcccaggcggcttccaaggcagcggcggctgcgggcgctccgaccccgcgcgcgcccccgaccggccccgccccctcggcttccctccccggcgggtcctagccgtcgcagtccagccgccgcctgccctcagccgcccgctggccgggagcggagcccctgtggtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagtgcagtggatcttcacatgaagttgggtgataacggagaagctttctttgttgaggagactgaagaagaatatgaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacgaggatcttcaaatgcttccttgaaagaagaagaatgtaaagagcctttgctcttccattctggggatcattaccccttatctgatggagattggtcccctttagagac

SEQ ID NO: 16399 - DNA, 4363 bp, Homo sapiens
cgaagacactcacctgtggagcctgtgcacgtaggtagaggcggcggctctgagtccaggagctccagtgggcagctccccagcaccagccatgaactacgtggggcagctggcggagacggtgtttgggacggtgaaggagctgtaccggggcctgaacccagccacactgagcggcggcattgacgtgctggtggtgaagcaggtggacggctcgttccggtgctcacccttccacgtgcgttttggcaagctgggcgtcctgcggtcgcgggagaaggtggtagacattgagctcaatggggagcctgtggacttgcacatgaagcttggggacagcggggaggccttctttgttcaggagctggagagcgatgatgaacatgtgcctcccggcctgtgcacctcacccatcccttgggggggtctgtctggcttcccctcggactcccagctgggcactgccagtgagcctgagggcctcgtcatggcaggcacggcctccactgggcggaggaagaggcgtcgcaggaggaaacccaagcagaaagaggatgcagtggcaactgattctagtccagaggaactggaggcaggcgctgagagtgagctatccctgccggaaaagctgaggccagagcccccaggtgtccagttggaagagaagtcttcactgcagcccaaagacatctacccctactcggatggcgagtggcccccccaggccagcctctcagcaggtgagctaacatcccctaagagcgactcggagctggaggtgcggaccccggagcccagtcccctaagagccgagtcccacatgcagtgggcctgggggaggctgcctaaggtggccagagctgagcggcccgagtcctcagtggtccttgaaggcagagctggggcaacctctcctcctcggggaggacccagcactccctctacctctgtggctggcggcgtggaccctttgggactcccaatccagcaaacagaggctggtgccgaccttcagcctgacacagaggatcccactctagtgggtccccctctccacaccccagagacagaggaaagcaagactcagagctctggggacatgggcctccctcctgcctccaagtcatggagctgggccactctggaggttccagttcccaccgggcagccagagagggtctccagggggaaaggctccccaaagagaagccagcacctgggccccagtgacatctacctggatgacttgccctccctggactctgagaatgcagcgctttacttcccccaaagtgactctgggctgggggccagaagatggagtgaacccagcagtcagaagtccctgagggaccccaaccctgaacatgaacctgaacccactctggacacagtggatacaatagcactgtccctctgtggtggactggctgacagccgggacatctccctagagaaattcaaccagcacagcgtctcttaccaggacctcaccaaaaaccccggacttttggatgacccaaacctagtggtgaaaatcaatggaaagcattataactgggctgtggctgcccccatgatcctctccctgcaagccttccagaaaaacttgcccaagagcaccatggacaagctggagagggagaagatgccccggaagggtgggcgatggtggttttcctggcgacgcagggacttcctggccgaggagcgcagtgcccagaaggagaagactgcagccaaggagcagcagggggagaagacagaagtcctgagcagtgatgacgatgccccagacagccctgtgatcctggagatcccctccttgccaccctccactccaccctccactcctacctacaagaagtccctccgcctctcctccgatcagatccggcgcctgaacctgcaagaaggtgccaatgatgtggtcttcagcgtgaccactcagtaccagggcacctgccgctgcaaggccaccatctacctgtggaaatgggacgacaaggtggtcatctctgacatcgacggcaccatcaccaagtcagatgctctgggccatatcctgccccagctggggaaagactggacacaccagggcatcaccagtctctatcacaaaatccaactaaatgggtacaagttcctgtactgctcggcgcgggccattggcatggcggacctcaccaaggggtacctgcagtgggtgagcgaggggggctgtagcctccccaagggccccatccttctgtctcccagcagcctcttctctgccctccacagagaggtgatcgagaagaaaccagaggtgttcaaggtcgcctgcctgagtgacatccagcagctgtttctgccccacggacagcccttctatgctgcctttgggaataggcccaatgatgtctttgcctaccggcaggtgggcctgcctgagtcacgcatcttcacagtcaacccccggggagagctcatccaggagctcataaagaaccacaaatccacgtatgagcggcttggtgaagtggtcgagctcctcttcccacctgtggcccgtggccccagcacagacctggccaaccctgaatacagtaacttctgctactggcgggagccactgcctgctgtggaccttgataccctggactgaacctgccctggctggctcctcctccctggcccggcccaggactggctaggtgtcctggggtataggagggtgggaattggagtgtcatggggcaaacccactgaaggggaaggaggaggctgcaggttggttggcagctagagagactcccccatcttccccgtcatatttttgccagctaagctgcagctgctccaggcgtcagtgtggcactgtcctggggcaattagcttgtcatctgggcccttgcagggttctttttttttttttttttttttttttcctgagacagggtcttgttctgttgcccaggctggagtgcagtggcatgatctctcggctcactgcaacctccgcctcccgggttcaagcgattcacctgcctcagcctcccaagtagctgggattacaggcgtgtaccaccacgcctggctaattttcgtgtttttagtagagatgggttttcaccacattggccaggctggtctcgaactcctgacctcaagtgatttgcccacctcggcctcccaaagtgctgggattacaggcatgagctaccatgccaggcctccttgcagggttttctatgcccttgatatctgtctccctgtcaacctgggaccttgctgtaagtcttgataggacagggagaagagggaggccctaccgaggctcgaggcttcagtgaagggtgacagcagtgggagtgtggtacagcctctggaaggacacagtgttctccccgccccttgtctgggagccaggactgtaccctccgaagccagacatcactgccaacatatcccccttgctggtgccctggcatctcagcacatgacacacacccacacctgcaggctgtggttccggcttggcctgctccccgtccggctgctgccgctgcctctctccagacctcgcttaaggacagtcccaaactcagctggggcaggtgttggcctgaaagtcctcccccagcctctgctggccagcttggtgctcacagctgctgggtaagctcttgcctaaggagctgtgggaagcagggctgatgccccagcaacctctcctcccactgtctttgaagaaagtagctttagaccggctaaaagctttaatccagagcctgccctactctgatagtaccagagtggagggcagaataccaaatgtccaggaaccaaaggcagggctgtggggacctgaagagcagcacagtggggcccgtgctgctgtgggggaaactgaggctgggagcctcagcagagaccggtgtcaagagtctctgggaactgcataggcctgaggaacatgcattttcaagttgtccattgatggtttcgtacctgaatttctcaccttttgtgaacatcttgggagggtgggggttttgcaggggtgttaaaagcaaggcttggagcccctttcctccagctggtggctccttctcagggcctggcctcattcaggccactttgtagagaaatgccctgacctcgcaggaaggatttccccacccccaagtggaaggaagaggacagtgtgggcaccagagggccctggaaacatcttaggggaaggaaaggaaaaggataaatttggagtggggggtctctaaacagattgcctggattccgttctttcctggggttctacagctgcctaagccctcaccttgggggaggatcaaagggaataaagagaactcttggctga

SEQ ID NO: 16400 - DNA, 4039 bp, Homo sapiens
agtccaggagctccagtgggcagctccccagcaccagccatgaactacgtggggcagctggcggagacggtgtttgggacggtgaaggagctgtaccggggcctgaacccagccacactgagcggcggcattgacgtgctggtggtgaagcaggtggacggctcgttccggtgctcacccttccacgtgcgttttggcaagctgggcgtcctgcggtcgcgggagaaggtggtagacattgagctcaatggggagcctgtggacttgcacatgaagcttggggacagcggggaggccttctttgttcaggagctggagagcgatgatgaacatgtgcctcccggcctgtgcacctcacccatcccttgggggggtctgtctggcttcccctcggactcccagctgggcactgccagtgagcctgagggcctcgtcatggcaggcacggcctccactgggcggaggaagaggcgtcgcaggaggaaacccaagcagaaagaggatgcagtggcaactgattctagtccagaggaactggaggcaggcgctgagagtgagctatccctgccggaaaagctgaggccagagcccccaggcagtgtccagttggaagagaagtcttcactgcagcccaaagacatctacccctactcggatggcgagtggcccccccaggccagcctctcagcaggtgagctaacatcccctaagagcgactcggagctggaggtgcggaccccggagcccagtcccctaagagccgagtcccacatgcagtgggcctgggggaggctgcctaaggtggccagagctgagcggcccgagtcctcagtggtccttgaaggcagagctggggcaacctctcctcctcggggaggacccagcactccctctacctctgtggctggcggcgtggaccctttgggactcccaatccagcaaacagaggctggtgccgaccttcagcctgacacagaggatcccactctagtgggtccccctctccacaccccagagacagaggaaagcaagactcagagctctggggacatgggcctccctcctgcctccaagtcatggagctgggccactctggaggttccagttcccaccgggcagccagagagggtctccagggggaaaggctccccaaagagaagccagcacctgggccccagtgacatctacctggatgacttgccctccctggactctgagaatgcagcgctttacttcccccaaagtgactctgggctgggggccagaagatggagtgaacccagcagtcagaagtccctgagggaccccaaccctgaacatgaacctgaacccactctggacacagtggatacaatagcactgtccctctgtggtggactggctgacagccgggacatctccctagagaaattcaaccagcacagcgtctcttaccaggacctcaccaaaaaccccggacttttggatgacccaaacctagtggtgaaaatcaatggaaagcattataactgggctgtggctgcccccatgatcctctccctgcaagccttccagaaaaacttgcccaagcgcagtgcccagaaggagaagactgcagccaaggagcagcagggggagaagacagaagtcctgagcagtgatgacgatgccccagacagccctgtgatcctggagatcccctccttgccaccctccactccaccctccactcctacctacaagaagtccctccgcctctcctccgatcagatccggcgcctgaacctgcaagaaggtgccaatgatgtggtcttcagcgtgaccactcagtaccagggcacctgccgctgcaaggccaccatctacctgtggaaatgggacgacaaggtggtcatctctgacatcgacggcaccatcaccaagtcagatgctctgggccatatcctgccccagctggggaaagactggacacaccagggcatcaccagtctctatcacaaaatccaactaaatgggtacaagttcctgtactgctcggcgcgggccattggcatggcggacctcaccaaggggtacctgcagtgggtgagcgaggggggctgtagcctccccaagggccccatccttctgtctcccagcagcctcttctctgccctccacagagaggtgatcgagaagaaaccagaggtgttcaaggtcgcctgcctgagtgacatccagcagctgtttctgccccacggacagcccttctatgctgcctttgggaataggcccaatgatgtctttgcctaccggcaggtgggcctgcctgagtcacgcatcttcacagtcaacccccggggagagctcatccaggagctcataaagaaccacaaatccacgtatgagcggcttggtgaagtggtcgagctcctcttcccacctgtggcccgtggccccagcacagacctggccaaccctgaatacagtaacttctgctactggcgggagccactgcctgctgtggaccttgataccctggactgaacctgccctggctggctcctcctccctggcccggcccaggactggctaggtgtcctggggtataggagggtgggaattggagtgtcatggggcaaacccactgaaggggaaggaggaggctgcaggttggttggcagctagagagactcccccatcttccccgtcatatttttgccagctaagctgcagctgctccaggcgtcagtgtggcactgtcctggggcaattagcttgtcatctgggcccttgcagggttctttttttttttttttttttttttttcctgagacagggtcttgttctgttgcccaggctggagtgcagtggcatgatctctcggctcactgcaacctccgcctcccgggttcaagcgattcacctgcctcagcctcccaagtagctgggattacaggcgtgtaccaccacgcctggctaattttcgtgtttttagtagagatgggttttcaccacattggccaggctggtctcgaactcctgacctcaagtgatttgcccacctcggcctcccaaagtgctgggattacaggcatgagctaccatgccaggcctccttgcagggttttctatgcccttgatatctgtctccctgtcaacctgggaccttgctgtaagtcttgataggacagggagaagagggaggccctaccgaggctcgaggcttcagtgaagggtgacagcagtgggagtgtggtacagcctctggaaggacacagtgttctccccgccccttgtctgggagccaggactgtaccctccgaagccagacatcactgccaacatatcccccttgctggtgccctggcatctcagcacatgacacacacccacacctgcaggctgtggttccggcttggcctgctccccgtccggctgctgccgctgcctctctccagacctcgcttaaggacagtcccaaactcagctggggcaggtgttggcctgaaagtcctcccccagcctctgctggccagcttggtgctcacagctgctgggtaagctcttgcctaaggagctgtgggaagcagggctgatgccccagcaacctctcctcccactgtctttgaagaaagtagctttagaccggctaaaagctttaatccagagcctgccctactctgatagtaccagagtggagggcagaataccaaatgtccaggaaccaaaggcagggctgtggggacctgaagagcagcacagtggggcccgtgctgctgtgggggaaactgaggctgggagcctcagcagagaccggtgtcaagagtctctgggaactgcataggcctgaggaacatgcattttcaagttgtccattgatggtttcgtacctgaatttctcaccttttgtgaacatcttgggagggtgggggttttgcaggggtgttaaaagcaaggcttggagcccctttcctccagctggtggctccttctcagggcctggcctcattcaggccactttgtagagaaatgccctgacctcgcaggaaggatttccccacccccaagtggaaggaag

SEQ ID NO: 16401 - DNA, 808 bp, Homo sapiens
tggtgaaaatcaatggaaagcattataactgggctgtggctgcccccatgatcctctccctgcaagccttccagaaaaacttgcccaagcgcagtgcccagaaggagaagactgcagccaaggagcagcagggggagaagacagaagtcctgagcagtgatgacgatgccccagacagccctgtgatcctggagatcccctccttgccaccctccactccaccctccactcctacctacaagaagtccctccgcctctcctccgatcagatccggcgcctgaacctgcaagaaggtgccaatgatgtggtcttcagcgtgaccactcagtaccagggcacctgccgctgcaaggccaccatctacctgtggaaatgggacgacaaggtggtcatctctgacatcgacggcaccatcaccaagtcagatgctctgggccatatcctgccccagctggggaaagactggacacaccagggcatcaccagtctctatcacaaaatccaactaaatgggtacaagttcctgtactgctcggcgcgggccattggcatggcggacctcaccaaggggtacctgcagtgggtgagcgaggggggctgtagcctccccaagggccccatccttctgtctcccagcagcctcttctctgccctccacagagaggtgatcgagaagaaaccagaggtgttcaaggtcgcctgcctgagtgacatccagcagctgtttctgccccacggacagcccttctatgctgcctttgggaataggcccaatgatgtctttgcctaccggcaggtgggcctgcc

SEQ ID NO: 16402 - DNA, 776 bp, Homo sapiens
acagcctctcccagccccagcaagcgacctgtcaggcggccgtggactcagactccggagatgaagcccctgctcctggccgtcagccttggcctcattgctgccctgcaggcccaccacctcctggcctcagacgaggagattcaggatgtgtcagggacgtggtatctgaaggccatgacggtggacagggagttccctgagatgaatctggaatcggtgacacccatgaccctcacgaccctggaagggggcaacctggaagccaaggtcaccatgctgataagtggccggtgccaggaggtgaaggccgtcctggagaaaactgacgagccgggaaaatacacggccgacgggggcaagcacgtggcatacatcatcaggtcgcacgtgaaggaccactacatcttttactgtgagggcgagctgcacgggaagccggtccgaggggtgaagctcgtgggcagagaccccaagaacaacctggaagccttggaggactttgagaaagccgcaggagcccgcggactcagcacggagagcatcctcatccccaggcagagcgaaacctgctctccagggagcgattagggggacaccttggctcctcagcagcccaaggacggcaccatccagcacctccgtcattcacagggacatggaaaaagctccccacccctgcagaacgcggctggctgcaccccttcctaccaccccccgccttccccctgccctgcgccccctctcctggttctccataaagagcttcagcagtt

SEQ ID NO: 16403 - DNA, 764 bp, Homo sapiens
cagcaagcgacctgtcaggcggccgtggactcagactccggagatgaagcccctgctcctggccgtcagccttggcctcattgctgccctgcaggcccaccacctcctggcctcagacgaggagattcaggatgtgtcagggacgtggtatctgaaggccatgacggtggacagggagttccctgagatgaatctggaatcggtgacacccatgaccctcacgaccctggaagggggcaacctggaagccaaggtcaccatgctgataagtggccggtgccaggaggtgaaggccgtcctggagaaaactgacgagccgggaaaatacacggccgacgggggcaagcacgtggcatacatcatcaggtcgcacgtgaaggaccactacatcttttactgtgagggcgagctgcacgggaagccggtccgaggggtgaagctcgtgggcagagaccccaagaacaacctggaagccttggaggactttgagaaagccgcaggagcccgcggactcagcacggagagcatcctcatccccaggcagagcgaaacctgctctccagggagcgattaggggcaggggacaccttggctcctcagcagcccaaggacggcaccatccagcacctccgtcattcacagggacatggaaaaagctccccacccctgcagaacgcggctggctgcaccccttcctaccaccccccgccttccccctgccctgcgccccctctcctggttctccataaagagcttcagcagtt

SEQ ID NO: 16404 - DNA, 564 bp, Homo sapiens
atgaggcaggggctgctggtgctggcgctggtgctggtgctggtgctagtgctggctgcagggtcccaggtgcaggagtggtaccccagggagtcccacgccctcaactggaacaagttttcagggttctggtacattctggccactgccactgatgcccagggattcttgccggccagggacaagaggaagctgggggcgtccgtggtaaaggtgaacaaagtgggccagctccgcgtgctcctcgccttcagacggggtcagggctgtgggcgggcacagccacgccatccgggaaccagcgggcatctctgggcatctctttcagtgaaaggggtgaaggccttccacgtgctgtccactgactacagctacggcttggtctacctccgcctggggcgtgcaacccaaaactacaagaacctgctgctcttccataggcagaatgtttcgagcttccagagtctgaaggaattcatggacgcttgtgacattctggggctctccaaggccgccgtcatcctcccgaaagacgcgtcccgtacacacaccatcctgccatga

SEQ ID NO: 16405 - DNA, 723 bp, Homo sapiens
ggcggctccagagaggtttaaacactggccttggcggctgagggaggagggtgaagatgaggcaggggctgctggtgctggcgctggtgctggtgctggtgctagtgctggctgcagggtcccaggtgcaggagtggtaccccagggagtcccacgccctcaactggaacaagttttcagggttctggtacattctggccactgccactgatgcccagggattcttgccggccagggacaagaggaagctgggggcgtccgtggtaaaggtgaacaaagtgggccagctccgcgtgctcctcgccttcagacggttgaaggggtgccagtcccaggaggtgatcctgaggaaagacgggaagaagccggtgtttgggaacgcctgtgcatacgcggcgggcccgagggaaggacaggagggagtgaaaggggtgaaggccttccacgtgctgtccactgactacagctacggcttggtctacctccgcctggggcgtgcaacccaaaactacaagaacctgctgctcttccataggcagaatgtttcgagcttccagagtctgaaggaattcatggacgcttgtgacattctggggctctccaaggccgccgtcatcctcccgaaagacgcgtcccgtacacacaccatcctgccatgagagccagcgtcctctgctcttccctttcgacgcgtggtcctcccagacccgaggagcgttgttc

SEQ ID NO: 16406 - DNA, 403 bp, Homo sapiens
acttttgagctaagtgatgatggccgctttgaggtgtggaatgcgatgactcgaggccagcactgtgacacatggtcttatgtgctgataccggcagcccagcctgggcagttcactgtggaccacggtgtggacacacgagcaggctggccgtcctcaggatcagcctgctgggcaggagctggttgctgcctcccgggacgctggaccagttcatctgcctgggcagagctcagggcctctcggatgacaacatcgtcttcccagatgtgactggctggtcaccccaggccagcgtctgttgaaggatgaagcagctcctgtccggcccagccctgcctcacagctgtgcgagctctgccctcctcagctctcaaacctgaataaatgcaccaagcccaga

SEQ ID NO: 16407 - DNA, 579 bp, Homo sapiens
atgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcgaggccagcactgtgacacatggtcttatgtgctgataccggcagcccagcctgggcagttcactgtggaccacggtgtggagcccggggcggacagagaggagacccgggtggtggacagcgactacacccagttcgccctgatgctgtcccgcagacacacgagcaggctggccgtcctcaggatcagcctgctgggcaggagctggttgctgcctcccgggacgctggaccagttcatctgcctgggcagagctcagggcctctcggatgacaacatcgtcttcccagatgtgactggctggtcaccccaggccagcgtctgttga

SEQ ID NO: 16408 - DNA, 822 bp, Homo sapiens
actcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcaggcc

SEQ ID NO: 16409 - DNA, 631 bp, Homo sapiens
ctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttagggagaaggcccagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacagtgagtgtggctg

SEQ ID NO: 16410 - DNA, 828 bp, Homo sapiens
actcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttagacagtggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcaggcc

SEQ ID NO: 16411 - DNA, 848 bp, Homo sapiens
ggcattcattctttcctttctgtgggtgtggggaggggaccacagggcacataccccaccctgggatccagctgagcaggggggtcagagatgacagctcttccggctcacaggccaccggcccacatacagggcaatcagaagaaagaaacagcacaaggaaggcacagagggagtcgttgtccctgccagaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacagtgagtg

SEQ ID NO: 16412 - DNA, 1109 bp, Homo sapiens
actcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcggtaatggccagtctggatgaggggacggggacatggggactgttcaggcaggatgcttccctaccagggatcagggagaggagggactccgtcctcagcttcagtcactggagcagtggatggtccaggagctccttggaagccactctgggcccaggaagactgtgccccaccccagggtctatgggactcccagggacccaggccgcaagtgctctttcctggcagtttagcccgggtctgcccagacaaggatttcaggcccaggcctgagtatccatttctcagtctcactggcctgacacctctggccaccctcccaggcccccttgttctgggccatctcccccgaccctcccaggcctcgtcaccctgggttttgctgtcctggctgtcctctctcccctggggacttgctcaccactgacttgggagctgtccttgactccagggagcctg

SEQ ID NO: 16413 - DNA, 711 bp, Homo sapiens
gggactgcacatcctgggcctgcggcgcagtgtagacctgggaggatgggcggcctgctgctggctgcttttctggctttggtctcggtgcccagggcccaggccgtgtggttgggaagactggaccctgagcagcttcttgggccctggtacgtgcttgcggtggcctcccgggaaaagggctttgccatggagaaggacatgaagaacgtcgtgggggtggtggtgaccctcactccagaaaacaacctgcggacgctgtcctctcagcacgggctgggagggtgtgaccagagtgtcatggacctgataaagcgaaactccggatgggtgtttgagaatccctcaataggcgtgctggagctctgggtgctggccaccaacttcagagactatgccatcatcttcactcagctggagttcggggacgagcccttcaacaccgtggagctgtacagtctgacggagacagccagccaggaggccatggggctcttcaccaagtggagcaggagcctgggcttcctgtcacagtagcaggcccagctgcagaaggacctcacctgtgctcacaagatccttctgtgagtgctgcgtccccagtagggatggcgcccacagggtcctgtgacctcggccagtgtccacccacctcgctcagcggctcccggggcccagcaccagctcagaataaagcgattccacagcaaa

SEQ ID NO: 16414 - DNA, 867 bp, Homo sapiens
atatgccaggagggtggctgggcaggctgctgtctaggccaggctaacccctgcggtgggcgtgggtgtcaccagggccgatggcgcttgtgcagaaacccacgtctctgagctgccagcagccaagctgtcctgatgacattcccgggtgggcgcacaagcctgcactgtccgtatagaatcggcccaggctgtgcagcaggggaacccggagcccggaccccgccacggaggccaggctgccgtgcaccatcctgggtgtcctcgtggtgctccgggcgcaggtggcagcagccatggaggagctggaccggcagaagattggaggattctggagggaagtcggtgtggcctccgatcaaagcctggtgctgacggccccgaagcgggtggagggcttgttcctcaccttgagcgggagtaacctgaccgtgaaggttgcatataacagctcaggaagctgtgagatagagaagatcgtgggctcagaaatagacagtacgggaaaattcgcttttcctggccacagagagatccacgtgctggacaccgactacgagggctacgccatcctgcgggtgtccctgatgtggcggggcaggaactttcgcgtcctcaagtactttactcggagccttgaggacaaggaccggctggggttctggaagtttcgggagctgacagcagacactggtctctacctggcggcccggcctgggcggtgtgccgagctcctgaaggaggagctgatttaatggagttcctgcctcagaccacaaggttcggagcgcccgcccacccctgcccctcctgggcaccctgcccaccaggtcacctgcacctgctctgaataaactgtgaagtcaa

SEQ ID NO: 16415 - DNA, 531 bp, Homo sapiens
atggctctgcttctgctgagcctggggctgagcctcatcgcagcccaggagttcgatccccacaccgttatgcagaggaactacaacgtggccagggtttcaggggtctggtattctattttcatggcctcagatgacctgaatcggattaaagaaaatggagacctgagggtcttcgtccggaatattgaacacttgaagaacggcagcctaatatttgatttcgaatacatggtgcagggggagtgtgtggctgtggtcgtggtctgcgagaagacagagaagaatggggaatactccatcaactatgagggccagaacacagtggccgtctcggagactgactacaggctgttcatcaccttccacctccagaacttcaggaacgggaccgagacccacacgctggcgctctatgaaacctgcgaaaagtacggacttggctcacaaaatatcatcgacttgaccaacaaagatccctgctactccaagcattacaggagcccgcccaggcctcccatgcggtggtaa

SEQ ID NO: 16416 - DNA, 1775 bp, Homo sapiens
agccaatcgtggagcagcttggctgcttgtcataaatggagcgacgtaatttcgacctgtcctttcccgggagttagcgatccctcaacccctgcactgcgctagtcctaaagaggaaatgtctctacgctgcggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggttaagactacctccatggctaaagacagagattcccatggggaaaaattacaataaactgaaaaatactttgcggaatttaaatctccatacagtatgtgaggaagctcgatgtcccaatattggagagtgttggggaggtggagaatatgccaccgccacagccacgatcatgttgatgggtgacacatgtacaagaggttgcagattttgttctgttaagactgcaagaaatcctcctccactggatgccagtgagccctacaatactgcaaaggcaattgcagaatggggtctggattatgttgtcctgacatctgtggatcgagatgatatgcctgatgggggagctgaacacattgcaaagaccgtatcatatttaaaggaaaggaatccaaaaatccttgtggagtgtcttactcctgattttcgaggtgatctcaaagcaatagaaaaagttgctctgtcaggattagatgtgtatgcacataatgtagaaacagtcccggaattacagagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggttgaagaatatattactcctgaaaaattcaaatactgggaaaaagtaggaaatgaacttggatttcattatactgcaagtggccctttggtgcgttcttcatataaagcaggtgaatttttcctgaaaaatctagtggctaaaagaaaaacaaaagacctctaaaacttcaacaagaccttcaagatcacagaaatttttaaaatttgattccagttaataacagaggtggtgccagaatgcctggactgcagtggatgtgccccacctctttgcttaaaaaaaaaaatgtcaatagccaggcatagtggctcacgcctgtaatcccagcactttaggaggccaaggcgggtggatcacctgaggtcaggagttcgagaccagcctggccaacatggtgaaatcctgtctccactaaaaacacaaaaattagtcaggcgtggtagtgggtgcctgtaatcccagctactcgggaggctaaggcaggagaatcacttgaacctgggagggggaggttgcagtgagccaagatcgctccattgccctccagcctgggtgacaagagcaaaactccatctcaaataaataaaaaggaaaaaaaagtcaataaactgtacaaatttaattacagtaattcatttggcttttagtgtatcttctttgtcccaattaaacagttgcttgctgtgatgtaatcttaaaa

SEQ ID NO: 16417 - DNA, 1594 bp, Homo sapiens
agccaatcgtggagcagcttggctgcttgtcataaatggagcgacgtaatttcgacctgtcctttcccgggagttagcgatccctcaacccctgcactgcgctagtcctaaagaggaaatgtctctacgctgcggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggttaagactacctccatggctaaagacagagattcccatggggaaaaattacaataaactgaaaaatactttgcggaatttaaatctccatacagtatgtgaggaagctcgatgtcccaatattggagagtgttggggaggtggagaatatgccaccgccacagccacgatcatgttgatgggtgacacatgtacaagaggttgcagattttgttctgttaagactgcaagaaatcctcctccactggatgccagtgagccctacaatactgcaaaggcaattgcagaatggggtctggattatgttgtcctgacatctgtggatcgagatgatatgcctgatgggggagctgaacacattgcaaagaccgtatcatatttaaaggaaaggaatccaaaaatccttgtggagtgtcttactcctgattttcgaggtgatctcaaagcaatagaaaaagttgctctgtcaggattagatgtgtatgcacataatgtagaaacagtcccggaattacagagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggtgaatttttcctgaaaaatctagtggctaaaagaaaaacaaaagacctctaaaacttcaacaagaccttcaagatcacagaaatttttaaaatttgattccagttaataacagaggtggtgccagaatgcctggactgcagtggatgtgccccacctctttgcttaaaaaaaaaaatgtcaatagccaggcatagtggctcacgcctgtaatcccagcactttaggaggccaaggcgggtggatcacctgaggtcaggagttcgagaccagcctggccaacatggtgaaatcctgtctccactaaaaacacaaaaattagtcaggcgtggtagtgggtgcctgtaatcccagctactcgggaggctaaggcaggagaatcacttgaacctgggagggggaggttgcagtgagccaagatcgctccattgccctccagcctgggtgacaagagcaaaactccatctcaaataaataaaaaggaaaaaaaagtcaataaactgtacaaatttaattacagtaa

SEQ ID NO: 16418 - DNA, 2110 bp, Homo sapiens
gtgcgatccccggcgcccgcgcgcgcccacagcgctccgccagagctgccgccgcggactcgccgggagtgggggtctccgctggtgccagcccgcttctggagaccctccgcctcctgccaacccctgctcttccaggtcgggccccggggttctgcggctgttagggacagaggcaaagaagggcaggacggtccggtttcccgtggatgttcccgcccgagaaagacagcaagttgtgtgtgcgcccgggacgcgggagggaaggtggccgccgcccgccagccatggaccatcatctttagtgcagaggatggaaagttgatgcccagtaagactgaagatccattctgcattacggaactgtggattatctgtgggtccctggtgatttcacaccttcattcactcctgcagtccctgaacacttacttggggtcctcattgccctatctggtgaaagatggcatccagcctgacttgtactggagtaatctgggctttgctgtcttttctttgtgctgccacctcctgcgtggggttctttatgccttactggctctggggatcacagctgggcaagcctgtgtccttcggtaccttccggaggtgctcatatcctgtgcatgatgagagtcggcagatgatggtgatggtggaggaatgtgggcgctatgcctccttccagggcatccccagcgcagaatggaggatctgcaccatagtgaccggcctgggttgtggcctcctcctcctggtggcgctcactgccctcatgggttgctgtgtttccgacctcatctccaggacagtgggaagagtggctggaggaattcagtttcttgggggcttgttgattggtgctggctgtgccctctaccccttgggctgggacagtgaggaagtccggcagacttgtggctacacttctggccagtttgacctggggaagtgtgaaatcggctgggcctactactgcacgggagcaggtgccactgccgccatgctgctgtgcacgtggctggcttgcttttcgggcaagaaacagaagcactacccatactgagatggagctaccaagagcagacagaggagaagatgggccaaaggggcttggagaggtcaaaacatccacctaccttcaaaaggtgggatagtagttctaatccaatacaatgctaataaaatgaaacccgataaaatcaggaacatgatataggaaggaaggattgtaggagatttgtgggggaaaaaaaaggagagtatagaatgatggagaaaaatggaccaaaggctaaaaatattgcagggcatcgggtgtttctattccacagagtattgttaatgtacaacacacacacacacacacacacacacacacacacacacacacacacaacaaatctacatatacaaacaagggtttgggttttagttttttttttttaaggtgaggactcagaaaatcaaagggctagtagaaacagtgttatgttgggaagcagggtacccccaaagatgttccctgtaggtcacggcactcccaaaagcacacaagcacatacagacatatgcatccccacacacgcctatgcacaaacgtggattatcgcacagactgggaggtttagtggtgcatttctcctctgttttctttttaatatacatttaaaatacagtattatcactttataaaacatacattaagcctaataaatggaccaataagccaaactatcagtattttgtatatcctgcataaactctaatttagttcctcaacatattttcagtgtttatgcagacctttagagttaagcctttgtatttccatgttattccacaatatgcaatatttctctgagtagcttctgctatgatattcttatgaagaaaaggggcaactttctgtccactataggagagaattcagccgaagatatgagagtaatgagagacattttccagtcattggatcgtgttttcttttgtccattattgtactgtgctgtaccacatttatttctatattcattttgtaaaaaatttaaaagtgctattttgtttgtatttgaaaatctctgtgaataaattctctctttgatcaata

SEQ ID NO: 16419 - DNA, 1675 bp, Homo sapiens
tgcctgtatgtctgaggctgggtttgaagcctccagcgtgtttggagttaatccccattaggttggactccgcccctttctcccaaaggtaaagcaaggttttcaggcatcactgcaaagggcagctagtattcccatccttgtctaacaagctgtaaggagaagttgtttctgagatctgagcctgaagagagggaacaagtcagtcagccttcgtggtcagaagagaaacctgtgaccatgaggagcagcctgaccatggtgggaaccctctgggccttcctgtcccttgttactgctgtgaccagttctaccagttacttcctaccttactggctctttggatcccagatggggaagccagtgtcattcagcacattccggaggtgcaactaccctgtgcggggagagggacacagtctgatcatggtggaagaatgtgggcgctatgccagcttcaatgccatcccaagcctggcctggcagatgtgcacagtggtgacaggtgccggctgtgctctgctgctcctggtggcactagctgctgtcctgggttgctgcatggaggagctcatctccagaatgatgggacgttgcatgggagcagcgcagtttgttggagggctgctgataagctcaggctgtgccttataccctttaggatggaatagcccggagataatgcaaacatgtgggaatgtctccaatcaatttcagttaggtacctgtcggcttggctgggcctattactgtgctggaggtggagcagctgcagccatgttgatctgcacctggctctcttgctttgctggaagaaaccccaagcctgtcatattggtggagagcatcatgaggaataccaattcttatgctatggagcttgaccattgcctcaaaccttgagctttgaaagaagattggagagggtgggaaaggggaggagggagccctgaaaagaggtactaaggattaggccatttgtcatctgactgtcattagcatagcctagtgtttgcatgctttttaaactaattgtcgttcattttcacttatctttaagccagtaggtcactggctgtttataaaattcatcagaggaaacattctcagacatttacccaactggcaagtcgtgctaacccgaagacccaaagtacccctttatgcaaaataggatccaaagctaaggctgggtaagaatagttgtgcagggagggagcacgagatgggcagagctggttcctaccactccattcacacagttcatcagttcattcccaagtatttattgtcacccccaaacatctctggagtactactgctcaatttttgtgtcgttatcaggagtataccttggctcttcctttttttctcctgcttccccccgcaccttgtggggaagcttcaggggagcgggggagggtgattcccagtggtggggaaaacattaatcaaggatacttgcatttagcctggagccccttcctcattatgctttagaatattcataggagttccatttgtattctggctgggtgatgagcaaaaaaaatatatagtagcaaatattctctcatcctttagagataaagaaatggtgttcatcaaatgtactgagaatagactagcatttgtggggcactcaataaatttaaattcatggtgacagtgacaa

SEQ ID NO: 16420 - DNA, 1666 bp, Homo sapiens
cacacacacacacacacacacagagctgctttgtccgctgtgaggttggaggtttggggactctgtgcccactaagctactttctatttcaagtgcctgtatgtctgaggctgggtttgaagcctccagcgtgtttggagttaatccccattaggttggactccgcccctttctcccaaaggtaaagcaaggttttcaggcatcactgcaaagggcagctagtattcccatccttgtctaacaagctgtaaggagaagttgtttctgagatctgagcctgaagagagggaacaagtcagtcagccttcgtggtcagaagagaaacctgtgaccatgaggagcagcctgaccatggtgggaaccctctgggccttcctgtcccttgttactgctgtgaccagttctaccagttacttcctaccttactggctctttggatcccagatggggaagccagtgtcattcagcacattccggaggtgcaactaccctgtgcggggagagggacacagtctgatcatggtggaagaatgtgggcgctatgccagcttcaatgccatcccaagcctggcctggcagatgtgcacagtggtgacaggtgccggctgtgctctgctgctcctggtggcactagctgctgtcctgggttgctgcatggaggagctcatctccagaatgatgggacgttgcatgggagcagcgcagtttgttggaggtacctgtcggcttggctgggcctattactgtgctggaggtggagcagctgcagccatgttgatctgcacctggctctcttgctttgctggaagaaaccccaagcctgtcatattggtggagagcatcatgaggaataccaattcttatgctatggagcttgaccattgcctcaaaccttgagctttgaaagaagattggagagggtgggaaaggggaggagggagccctgaaaagaggtactaaggattaggccatttgtcatctgactgtcattagcatagcctagtgtttgcatgctttttaaactaattgtcgttcattttcacttatctttaagccagtaggtcactggctgtttataaaattcatcagaggaaacattctcagacatttacccaactggcaagtcgtgctaacccgaagacccaaagtacccctttatgcaaaataggatccaaagctaaggctgggtaagaatagttgtgcagggagggagcacgagatgggcagagctggttcctaccactccattcacacagttcatcagttcattcccaagtatttattgtcacccccaaacatctctggagtactactgctcaatttttgtgtcgttatcaggagtataccttggctcttcctttttttctcctgcttccccccgcaccttgtggggaagcttcaggggagcgggggagggtgattcccagtggtggggaaaacattaatcaaggatacttgcatttagcctggagccccttcctcattatgctttagaatattcataggagttccatttgtattctggctgggtgatgagcaaaaaaaatatatagtagcaaatattctctcatcctttagagataaagaaatggtgttcatcaaatgtactgagaatagactagcatttgtggggcactcaataaatttaaattcatggtgacagtga

SEQ ID NO: 16421 - DNA, 5043 bp, Homo sapiens
gggcagggcggctcggccgcctctttctctcgctgcccccgcccctcctcctcctccctctccccgagtgctagcccgggcggccgccgagcttggcgctctctcgcctcgctgcctcctcccccgcgccgcggaccctctcccctcccttgcgttgcccccctctcccgccgcctcctcccgctctcctctcgctctcctcccgcctccttcttccaggcgcggccagcgggggcaagagcgaggtggctgcgaggaggcgtcactgaaagccctgacttggggaaggctgcgggctcggagccggagacgccgagctggggccgggtgagttgggaatcagactcttgagttgacagctggcctatggtttctgcattttgttaagaagcacctcatgcaagcgagggacctgggactgctcacagccaggtggcatttttctgaagttgttcattaagacttcccagcattcctacagatataaataggtgaggccgcaggcggtgctctgggtccgggagcgctgtccccagcatgaacgcggccggcggcgggagtgaatgactgcagctgcgacttccttcccgggccgcccgagcctccttccccaccgactttcttgttttgattaactccgtggactcctgactctttcttcgcccggaacatcaatatgtgtcatgtcattgtcacctgtcgctcgatgctctggaccttgctgagtattgtggtggcttttgccgagctcattgccttcatgagtgcagactggctgatcgggaaagcgaggagccgcggcggcgtggagccggcgggcccgggcgggggctccccggagccctaccaccccaccctgggcatctacgcccgctgcatccggaacccaggggtgcagcacttccagcgggacacgctgtgcgggccctacgccgagagcttcggcgagatcgccagcggcttctggcaggccacagctattttcctggctgtgggaatctttattctctgcatggtggccttggtgtccgtcttcaccatgtgtgtacagagcatcatgaagaaaagcatcttcaatgtctgtgggctgttgcaaggaattgcaggtctattccttatcctcggtttgatactctaccctgctggctggggttgccagaaggccatagactactgtggacattatgcatctgcctacaaacctggagactgctccttgggctgggccttttataccgccattgggggcacagtcctcactttcatctgtgctgtcttctctgcacaagcagaaattgcaacctctagtgacaaagtacaggaagaaattgaagaggggaaaaatctgatctgcctcctttagtttggaagagacaatgccattttctcccttgagtaatcttgtgaaacagtccacagtttcatcatttgagtcaagtggagaactaacctttacctaccaaagccacgttccacggcccgaggcttaaacaggaccaatgagaggccacatccagctacgcaaagttactggacatgcggtctgcagtgcacattataaggaatggaacatgaaaatagtatataatcctagacctggagttgccaagttctgtcagactccatctcccccaggttcaatgaaggataataatctaaatcattagggcagcagtttctctggtaacggaagagaccgtccgccagatctgcaggctgtttctgctccaacactgcttgcttgtgagcatctctgcctcagaatggggttttgggttggagttcttgttttcctctgttctttcaagttgtctccaacgaacagaaaactataaacttactggggacaggatgtgtgctaaagggcacagcaagacactgtcttttgcttagctgaccaaaggggtcagcagggatggcgtggagtcatgctgtggaacttattctaggctgaatcctagggtaaggtggatcaactgaactgtcactccagagattttagaaatttgagtaaagaaacaataaggacctatacaatcatatgagaacaaaaatatgaaatcttgctagtgaagacgtattttttcttcttcccagcagccaggctagcaccagttctggcccagtctcctcttcttctggagatcacatgtttttcttctaaggttaggattgtgctttgactgcgaaaggaaacctcactgtttcctccttccagggactgaggtctccaagctagctgtggcttatgcagatgttcactgggaggacctgccagaatctcggcacttggggggagacctttactcccagtttggtgaccatgctgtagtcagctctatttccaatcccgacagtagcagaatggcattctacaacaaaaagaagctagttatgggagttaagtttttgtagttactggtgttgatcctgaaagcagactgagataacattaaattgctgcaactgaagaactgcagccaagaccttaattccaggaaagcacagaggacaaagttaattcaaaaagaggcgctagatcaaggtcacagcactgcctacacctgtttacaaaaagaatcaaataccactatgaataaggattcaggggtttttaatctactttccataaattaccaatatcactgattcaggaagatagtatctcagaatgaccagagcagcacagaaacaagctactctgacattatgggagcttcaaaattgtatcatgatacagaaacactccttagcactttaagaaagtgagatggaactgccagatttctggaaggagaaaaagtgtaggtatttgggttcattaatctgctcacttgaggactttgttttgaaaaagtaccttctgtggacaaggtattgtgctaccagctatacaaccctgacttcagagtttgcaaccttgccctgagtgaatcatgttaaagctgtctgagtctaaagcaccgtatcttggtgcagaacagataattatacagagatggaatgggacaaccgcagttttactacattctggtgtttggcctatatgagaaaccatcttctcacagattaagggctaagggcaaaaggggtgggaggtgtggaactagccttaatgagtttcccattcctgaaccaaaattcaaagtgagtgagatgtaaatcctgtgattttggtgaagaaaaaaacgggtatcttcatagcagcctaggaaaccttaaccatatctctaacaccacacagaaagaggctggaggagccactggacaaagcttctgtctctgtgtgtacatttataatgttctaaccaagtctcaaaccttgatgaaaaacacaaaatttttccataaacttatcagaagactcacttttctttctttcttggatagagaaaccattttctgacactaggtttacaatctcagtgtccttacaagttaagtcctaagctcacaggatcctccgagcatgtccatcacctgctctttggctaaggtggcagtgtacctctagatcaacctgggaacagtcacaagggagtgtgacttcttggccataataaactcactcgatagtgtttatgttattaatctgaatgcaacagaagacaaaagcacaggcatgcacacacacagaaccccaaaccactaaaaactacctaaacactgacttagtaaatagtaaaaaggtaatgttgggacttttaaaccttgaatccattagccaggcttgggatgaaaggaccatctaaaatcatgctagtctaaaccatgctcttccacacagctgtttaaaaaccactgggtatgaggaatatgctagaaagaaatgttaaaaatagattgttggctcacacttatttttctaataaataggaccattattactaccaggaaagtcttatttattttgcctgaaattggcttaaagaaagtctcatgacgggatgggatgggctgcgcttctcaatgaactctgaggcagaaatatttgccttggattctgtggattctttaaacctgtgtgctaataattcaaacaatgttgcattaattgtataagggtttttgtatagttttcaaacatctgtggtgtaatgatctttgttaaacatatattctgtaaagtgccatagtctttttttatgtgtagcatatttaaaaatatatatgtatattatacatacacaagtttgtgtgaaagatgtgcaataacaaaggtgtatgtatgttttgttgttttgttttggaaactggacaggagtcaaaacagggatgtttgtttctgttttggcaaggagagttccacatttttgccttcatggcttattcagtaacccataattttaatgctacacaaatcttatgtgaagaaaagactggtatgaaatcattttttcctgggtctaaaataatcgctagtgttatgtcaaagttaagcccgcacgccaggcccagttaatgctagtctttcatgtgaaatgtgaagctgccatgttgccttttctcttagtaggataactagtagctggtacataatcactgaggagctatttcttaacatgcttttatagaccatgctaatgctagaccagtatttaagggctaatctcacacctccttagctgtaagagtctggcttagaacagacctctctgtgcaataacttgtggccactggaaatccctgggccggcatttgtattggggttgcaatgactcccaagggccaaaagagttaaaggcacgactgggatttcttctgagactgtggtgaaactccttccaaggctgagggggtcagtaggtgctctggagggactcggcaccacttgatattcaacagccacttgagccaaatataaaattgtatttacagctgatggactcaatttgagccttcaaacttgtagttatcctattatattgtaaactaatacattgtctagcattgatttggttcctgtgcatatgtattttcactatgtgctcccctccccagatcttaattaaaccagattttgcaattcattcttattctttc

SEQ ID NO: 16422 - DNA, 4664 bp, Homo sapiens
acacgtgaaggaagcctttgtgggccttcctgcgcagctgactagctgaaagccatcgtgagccagcccaggagaaaccagcagaggaacagccagccgaaccctgggattgtgagaaataatcaggtgaggccgcaggcggtgctctgggtccgggagcgctgtccccagcatgaacgcggccggcggcgggagtgaatgactgcagctgcgacttccttcccgggccgcccgagcctccttccccaccgactttcttgttttgattaactccgtggactcctgactctttcttcgcccggaacatcaatatgtgtcatgtcattgtcacctgtcgctcgatgctctggaccttgctgagtattgtggtggcttttgccgagctcattgccttcatgagtgcagactggctgatcgggaaagcgaggagccgcggcggcgtggagccggcgggcccgggcgggggctccccggagccctaccaccccaccctgggcatctacgcccgctgcatccggaacccaggggtgcagcacttccagcgggacacgctgtgcgggccctacgccgagagcttcggcgagatcgccagcggcttctggcaggccacagctattttcctggctgtgggaatctttattctctgcatggtggccttggtgtccgtcttcaccatgtgtgtacagagcatcatgaagaaaagcatcttcaatgtctgtgggctgttgcaaggaattgcaggtctattccttatcctcggtttgatactctaccctgctggctggggttgccagaaggccatagactactgtggacattatgcatctgcctacaaacctggagactgctccttgggctgggccttttataccgccattgggggcacagtcctcactttcatctgtgctgtcttctctgcacaagcagaaattgcaacctctagtgacaaagtacaggaagaaattgaagaggggaaaaatctgatctgcctcctttagtttggaagagacaatgccattttctcccttgagtaatcttgtgaaacagtccacagtttcatcatttgagtcaagtggagaactaacctttacctaccaaagccacgttccacggcccgaggcttaaacaggaccaatgagaggccacatccagctacgcaaagttactggacatgcggtctgcagtgcacattataaggaatggaacatgaaaatagtatataatcctagacctggagttgccaagttctgtcagactccatctcccccaggttcaatgaaggataataatctaaatcattagggcagcagtttctctggtaacggaagagaccgtccgccagatctgcaggctgtttctgctccaacactgcttgcttgtgagcatctctgcctcagaatggggttttgggttggagttcttgttttcctctgttctttcaagttgtctccaacgaacagaaaactataaacttactggggacaggatgtgtgctaaagggcacagcaagacactgtcttttgcttagctgaccaaaggggtcagcagggatggcgtggagtcatgctgtggaacttattctaggctgaatcctagggtaaggtggatcaactgaactgtcactccagagattttagaaatttgagtaaagaaacaataaggacctatacaatcatatgagaacaaaaatatgaaatcttgctagtgaagacgtattttttcttcttcccagcagccaggctagcaccagttctggcccagtctcctcttcttctggagatcacatgtttttcttctaaggttaggattgtgctttgactgcgaaaggaaacctcactgtttcctccttccagggactgaggtctccaagctagctgtggcttatgcagatgttcactgggaggacctgccagaatctcggcacttggggggagacctttactcccagtttggtgaccatgctgtagtcagctctatttccaatcccgacagtagcagaatggcattctacaacaaaaagaagctagttatgggagttaagtttttgtagttactggtgttgatcctgaaagcagactgagataacattaaattgctgcaactgaagaactgcagccaagaccttaattccaggaaagcacagaggacaaagttaattcaaaaagaggcgctagatcaaggtcacagcactgcctacacctgtttacaaaaagaatcaaataccactatgaataaggattcaggggtttttaatctactttccataaattaccaatatcactgattcaggaagatagtatctcagaatgaccagagcagcacagaaacaagctactctgacattatgggagcttcaaaattgtatcatgatacagaaacactccttagcactttaagaaagtgagatggaactgccagatttctggaaggagaaaaagtgtaggtatttgggttcattaatctgctcacttgaggactttgttttgaaaaagtaccttctgtggacaaggtattgtgctaccagctatacaaccctgacttcagagtttgcaaccttgccctgagtgaatcatgttaaagctgtctgagtctaaagcaccgtatcttggtgcagaacagataattatacagagatggaatgggacaaccgcagttttactacattctggtgtttggcctatatgagaaaccatcttctcacagattaagggctaagggcaaaaggggtgggaggtgtggaactagccttaatgagtttcccattcctgaaccaaaattcaaagtgagtgagatgtaaatcctgtgattttggtgaagaaaaaaacgggtatcttcatagcagcctaggaaaccttaaccatatctctaacaccacacagaaagaggctggaggagccactggacaaagcttctgtctctgtgtgtacatttataatgttctaaccaagtctcaaaccttgatgaaaaacacaaaatttttccataaacttatcagaagactcacttttctttctttcttggatagagaaaccattttctgacactaggtttacaatctcagtgtccttacaagttaagtcctaagctcacaggatcctccgagcatgtccatcacctgctctttggctaaggtggcagtgtacctctagatcaacctgggaacagtcacaagggagtgtgacttcttggccataataaactcactcgatagtgtttatgttattaatctgaatgcaacagaagacaaaagcacaggcatgcacacacacagaaccccaaaccactaaaaactacctaaacactgacttagtaaatagtaaaaaggtaatgttgggacttttaaaccttgaatccattagccaggcttgggatgaaaggaccatctaaaatcatgctagtctaaaccatgctcttccacacagctgtttaaaaaccactgggtatgaggaatatgctagaaagaaatgttaaaaatagattgttggctcacacttatttttctaataaataggaccattattactaccaggaaagtcttatttattttgcctgaaattggcttaaagaaagtctcatgacgggatgggatgggctgcgcttctcaatgaactctgaggcagaaatatttgccttggattctgtggattctttaaacctgtgtgctaataattcaaacaatgttgcattaattgtataagggtttttgtatagttttcaaacatctgtggtgtaatgatctttgttaaacatatattctgtaaagtgccatagtctttttttatgtgtagcatatttaaaaatatatatgtatattatacatacacaagtttgtgtgaaagatgtgcaataacaaaggtgtatgtatgttttgttgttttgttttggaaactggacaggagtcaaaacagggatgtttgtttctgttttggcaaggagagttccacatttttgccttcatggcttattcagtaacccataattttaatgctacacaaatcttatgtgaagaaaagactggtatgaaatcattttttcctgggtctaaaataatcgctagtgttatgtcaaagttaagcccgcacgccaggcccagttaatgctagtctttcatgtgaaatgtgaagctgccatgttgccttttctcttagtaggataactagtagctggtacataatcactgaggagctatttcttaacatgcttttatagaccatgctaatgctagaccagtatttaagggctaatctcacacctccttagctgtaagagtctggcttagaacagacctctctgtgcaataacttgtggccactggaaatccctgggccggcatttgtattggggttgcaatgactcccaagggccaaaagagttaaaggcacgactgggatttcttctgagactgtggtgaaactccttccaaggctgagggggtcagtaggtgctctggagggactcggcaccacttgatattcaacagccacttgagccaaatataaaattgtatttacagctgatggactcaatttgagccttcaaacttgtagttatcctattatattgtaaactaatacattgtctagcattgatttggttcctgtgcatatgtattttcactatgtgctcccctccccagatcttaattaaaccagattttgcaattc

SEQ ID NO: 16423 - DNA, 1852 bp, Homo sapiens
ctgggctgaggcggaggcaggggagttgcagcgcgcgaggctccgtgagtgtgtctcctgcgcgctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccgctgcctgccttgtgcttggctgtatgattttccctgatggctgggactcagatgaagtaaaacggatgtgtggagaaaagacagacaagtacactcttggggcttgctcagtccgctgggcatacatcctggctattattggaattttggatgccctgatcctctcatttctagcatttgtgcttggtaatcgacaagacagcttgatggcagaggaactgaaggcagaaaacaaagttctgctaagccaatattctctagaatgagcacaaaacaaatcgaataacagctaaacaaatcgaataacagctaaacgaatcgaataacagcttttgtacatcaacatcaagaaggaatacgcctgagagagatcagagtatatagatgaatatgaacaagaatggaacattcacttgtcaacgcactttctaaatctagatcagcagagatgggagtgattttctggaaagagatgtgatcatggattaaacaccagctcattggaaactcattggatgagatcagaaaacgttcatgaaaaatcatattcaggaaataaggaagaggaatataaatgctctagagttaacatgtaaaatatatacgtactgaggtttgtaaactgtcctttttaaatcaaactgaaaacaaaaagctttaacctttcaacagaatttttaaaaaggcagttagttctaaattattcctatctcaatagccaagaggctgatcaagcgtcatttattgaggaagcatcttagaaaatgcctctgaatgttttcataggagccgtgacctttggttcttcatctctaccattcatttacttcactgtgtaattagttacaaccactcagttattaagagacgtaacgcttcaaactttttaccaagtctgtgttctgtttaatctgtccatacaagttattactgagaaagtgtttatgccatatactattactccatcaagctgtatattacaggaagtacatctttacatcataggttcccaagcaacatagatttccctatctttcaggaaacagcatcaaggaactctgaaaaatatagaaaaagttcattttcaccttggaagctcacgtgtaatattataggctactatcaaataaacactttttttctaattctccctagtatatgcataggaatttaatatactttataaataagtatctaaaatgtctcctacttttttcctatttctttgccatacatgttatcagaaatccatgtcttctatttcccttactgatgggcactca

SEQ ID NO: 16424 - DNA, 3174 bp, Homo sapiens
ctgggctgaggcggaggcaggggagttgcagcgcgcgaggctccgtgagtgtgtctcctgcgcgctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccggtgactgccttgtgctttttgatttgcatttccctgatggctgggactcagatgaagtaaaacggatgtgtggagaaaagacagacaagtacactcttggggcttgctcagtccgctgggcatacatcctggctattattggaattttggatgccctgatcctctcatttctagcatttgtgcttggtaatcgacaagacagcttgatggcagaggaactgaaggcagaaaacaaagttctgctaagccaatattctctagaatgagcacaaaacaaatcgaataacagctaaacaaatcgaataacagctaaacgaatcgaataacagcttttgtacatcaacatcaagaaggaatacgcctgagagagatcagagtatatagatgaatatgaacaagaatggaacattcacttgtcaacgcactttctaaatctagatcagcagagatgggagtgattttctggaaagagatgtgatcatggattaaacaccagctcattggaaactcattggatgagatcagaaaacgttcatgaaaaatcatattcaggaaataaggaagaggaatataaatgctctagagttaacatgtaaaatatatacgtactgaggtttgtaaactgtcctttttaaatcaaactgaaaacaaaaagctttaacctttcaacagaatttttaaaaaggcagttagttctaaattattcctatctcaatagccaagaggctgatcaagcgtcatttattgaggaagcatcttagaaaatgcctctgaatgttttcataggagccgtgacctttggttcttcatctctaccattcatttacttcactgtgtaattagttacaaccactcagttattaagagacgtaacgcttcaaactttttaccaagtctgtgttctgtttaatctgtccatacaagttattactgagaaagtgtttatgccatatactattactccatcaagctgtatattacaggaagtacatctttacatcataggttcccaagcaacatagatttccctatctttcaggaaacagcatcaaggaactctgaaaaatatagaaaaagttcattttcaccttggaagctcacgtgtaatattataggctactatcaaataaacactttttttctaattctccctagtatatgcataggaatttaatatactttataaataagtatctaaaatgtctcctacttttttcctatttctttgccatacatgttatcagaaatccatgtcttctatttcccttactgatgggcactcatttttatttttttaaaaatcattccattaaacatatttctaaataatagtaagtggtactaacaaaataaataataatttaatagccttagaaataaatgactgtatacttatacaggttgaaaaaaactcggtaggaataagttacctttttgtttactaatgttggtttcaaaaatactcagattcattttagttggctgacatctggaagtagttaacaactaaccagtggacttcaacaatcatttgctcccaggcttcccccatcatcaccctcaccacatatcctgctaatatccaacaacaaacaaatatttaatattgaaatagcccattgcctgagaatgaacacaagctaaaatacatgcaagggtacttaatggaagccaaaccatgttctatacctaaggagaaaacatggacatgtagaatgcttttattcatgtattcaaaatcagaacaaatcagtgtatatcactagaacatcagatggaggataacacaagaagtgatacagatcagggttcacttctcttaccctctctctgttaggaccacattcctattttagccaaatgtttctggtacgggccatcttttcaccataaatggcattatgtttcaaatggctaaaagcatattatgggtatgctcaaaggagtaaaacccaattcacagagatgtggcttttctaaagaaccaaattaagggaatacttagtatctacaactaaagtattagtcattctgaggattatttgttgctttaagtattagctccctactacatccataacaccctacttactaaatttaattacacacaacttttcaagaattcgtattttatttgaagggaggtacctgtctactttatctacaataaaaacaaagggtattggctttctctaatccatgcaaactacaaattccatcgggagtcctacatcactaacagtggtatgaacaaaactaagaaagtacttcctatccacatgtgaatgttttaaaaaagtttttgccataaaacctaagtgtaatttagcataccacagtgctctgaagatgggtcattgacgatgtaccatttgtatataggtaatacacatgtaaatcactaattgttaattaaatataagaagtaggtttttatctttttaaaaaaaaaacaaaaaaggtgactccctttctcattctgttctgttgtattgcgtccaaaagttgtgtgtaatttttttaaggtccaagaaatgtaaagaaatttgttggaatacctgaatttctgtaaaaaaataaaaataaaaataagattttgttactt

SEQ ID NO: 16425 - DNA, 1379 bp, Homo sapiens
gtgagtgtgtctcctgcgcgctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccggtgactgccttgtgctttttgatttgcatttccctgatggctgggactcagatgaagtaaaacggatgtgtggagaaaagacagacaagtacactcttggggcttgctcagtccgctgggcatacatcctggctattattggaattttggatgccctgatcctctcatttctagcatttgtgcttggtaatcgacaagacagcttgatggcagaggaactgaaggcagaaaacaaagatgatggaaatgcttaaggcaaactaaggtagtgtgagaccacaccatttctgctaagccaatattctctagaatgagcacaaaacaaatcgaataacagctaaacaaatcgaataacagctaaacgaatcgaataacagcttttgtacatcaacatcaagaaggaatacgcctgagagagatcagagtatatagatgaatatgaacaagaatggaacattcacttgtcaacgcactttctaaatctagatcagcagagatgggagtgattttctggaaagagatgtgatcatggattaaacaccagctcattggaaactcattggatgagatcagaaaacgttcatgaaaaatcatattcaggaaataaggaagaggaatataaatgctctagagttaacatgtaaaatatatacgtactgaggtttgtaaactgtcctttttaaatcaaactgaaaacaaaaagctttaacctttcaacagaatttttaaaaaggcagttagttctaaattattcctatctcaatagccaagaggctgatcaagcgtcatttattgaggaagcatcttagaaaatgcctctgaatgttttcataggagccgtgacctttggttct

SEQ ID NO: 16426 - DNA, 2147 bp, Homo sapiens
gggcgctggccgcggtgctgaaacggcgccctccgcggacggaggagggggcggggctctcgggagccgtgagccgggaagagggagacgggcagggcggcgccagcaggccctggtgggcttgggaggaggcaggagactggagacagcctcggctagagcggacacaggcacctggcaagctttccttgaccaaatcaaggttgtccttgtcctattaagcctcttccccttgccttgaagggacctcacctggtgccctgacctcagcctcctccccaaaccccgctggggagtgacctgcttctaggcctccatccacaaagctacggacttgcagcccacgggaccccagcccagggcctgctgccctcaccatggtgaaattgctgccggcccaggaggcagccaagatctaccataccaactatgtgcggaactcgcgagccgtgggcgtgatgtggggtaccctcaccatctgcttctccgtactggtcatggccctcttcatccagccctactggatcggcgacagcgtcaacacaccgcaggcaggctacttcggccttttctcctactgcgtgggtaacgtgctgtcctccgagctcatctgcaagggcggccccctagacttctcctccatcccctctagagccttcaagactgccatgttctttgtggccttgggcatgttcctcatcattggctccatcatctgcttcagcctgttcttcatctgcaacacggccacagtctataagatctgtgcatggatgcagctggctgcggccacaggcctaatgattggctgcctggtctaccctgatggttgggactcaagtgaggtgcggcgcatgtgtggggagcagacgggcaagtacacgctgggccactgcaccatccgctgggccttcatgctggccatcctcagcattggcgacgccctcatcctctccttcctggccttcgtgttgggctaccggcaggacaagctcctccctgacgactacaaggcagatggaaccgaggaggtgtgaagcagctgaagggtcggtcatctatttcccagacacaggaaaactagggaatcaaattcttcagagataagaacttgttcttccaagtttccttgttcctggctactataggcctgaagcctgaagccttttattataacactaaaactggacagtctcctgagacaagacctcctactgtactctttctggggaagcagaactgcagtgacccacttcaaagatattcagaggctgagcggtgcagggagtgctcagttgctggggatgggatccaagtccatttcttagttccacacagcagcaaatcgcttcaccttcttgaagcctctcctctgtaaagcgagagggctaaatgggtccatctctaggggccttccctcccaggtctgtgtctgatagcatacacacacacatatatatacacacacacacacacacacacacacacacacacacatacatacacacacacatatatatacacacacacacacacacacacacacacactctctctctctctcaaacacacacaaatgcccaaccagctctaagagggcactgaagaggtggctggacatgtgctgggtcatttttagggtgaggtgtagggggtcttttgcttctcccttctcatattttgttttcttattgctgctcagaggggggtaaggaatggaggggccatcagaacttgaatcctttaacatccaccaggaagttttatgaagagtgggtgataggatctaaaatctctgcagacttttttcctcccgggagccaaatatcacatttccttatggtgcccacactgactcaaccagaactggctaccagcttcagaaatgtgttacttatgttcaagtaatttgttataggaatagatgacatttttttttttcaaaaactttggatttggcatatagtcatctatagggggattggttccaggatcccctgcagatgccaaaatacatggatgcccaagtcctcagctaaaaatagcgtagtatttgcatataacctatgcacatcctcctgtatactttaaatcatctctagattacttataatacctaatacaatgtaaatgctatgtaaatactc

SEQ ID NO: 16427 - DNA, 1038 bp, Homo sapiens
ggggcgctggccgcggtgctgaaacggcgccctccgcggacggaggagggggcggggctctcgggagccgtgagccgggaagagggagacgggcagggcggcgccagcaggccctggtgggcttgggaggaggcaggagactggagacagcctcggctagagcggacacaggcacctggcaagctttccttgaccaaatcaaggttgtccttgtcctattaagcctcttccccttgccttgaagggacctcacctggtgccctgacctcagcctcctccccaaaccccgctggggagtgacctgcttctaggcctccatccacaaagctacggacttgcagcccacgggaccccagcccagggcctgctgccctcaccatggtgaaattgctgccggcccaggaggcagccaagatctaccataccaactatgtgcggaactcgcgagccgtgggcgtgatgtggggtaccctcaccatctgcttctccgtactggtcatggccctcttcatccagccctactggatcggcgacagcgtcaacacaccgcaggcaggctacttcggccttttctcctactgcgtgggtaacgtgctgtcctccgagctcatctgcaagggcggccccctagacttctcctccatcccctctagagccttcaagactgccatgttctttgtggccttgggcatgttcctcatcattggctccatcatctgcttcagcctgttcttcatctgcaacacggccacagtctataagatctgtgcatggatgcagctggctgcggccacaggcctaatgattggctgcctggtctaccctgatggttgggactcaagtgaggtgcggcgcatgtgtggggagcagacgggcaagtacacgctgggccactgcaccatccgctgggccttcatgctggccatcctcagcattggcgacgccctcatcctctccttcctggccttcgtgttgggctaccggcaggacaagctcctccctgacgactacaaggcagatggaaccgaggaggtgtga

SEQ ID NO: 16428 - DNA, 1961 bp, Homo sapiens
gatgtcgcaagcaggttccagtccctgtgcctccccttcccgctcccaggaacccatccagcctcaggaactgcccccagccatcgagccttggctacttaagggacctgggcccaatccacagctgggacagtcctggcccactgcactgggaatctaggatgggggccttggccagagccctgccgtccatactgctggcattgctgcttacgtccaccccagaggctctgggtgccaaccccggcttggtcgccaggatcaccgacaagggactgcagtatgcggcccaggaggggctattggctctgcagagtgagctgctcaggatcacgctgcctgacttcaccggggacttgaggatcccccacgtcggccgtgggcgctatgagttccacagcctgaacatccacagctgtgagctgcttcactctgcgctgaggcctgtccctggccagggcctgagtctcagcatctccgactcctccatccgggtccagggcaggtggaaggtgcgcaagtcattcttcaaactacagggctcctttgatgtcagtgtcaagggcatcagcatttcggtcaacctcctgttgggcagcgagtcctccgggaggcccacagttactgcctccagctgcagcagtgacatcgctgacgtggaggtggacatgtcgggagacttggggtggctgttgaacctcttccacaaccagattgagtccaagttccagaaagtactggagagcaggatttgcgaaatgatccagaaatcggtgtcctccgatctacagccttatctccaaactctgccagttacaacagagattgacagtttcgccgacattgattatagcttagtggaagcccctcgggcaacagcccagatgctggaggtgatgtttaagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatgataccgcctgactctaatatccgactgaccaccaagtccttccgacccttcgtcccacggttagccaggctctaccccaacatgaacctggaactccagggatcagtgccctctgctccgctcctgaacttcagccctgggaatctgtctgtggacccctatatggagatagatgcctttgtgctcctgcccagctccagcaaggagcctgtcttccggctcagtgtggccactaatgtgtccgccaccttgaccttcaataccagcaagatcactgggttcctgaagccaggaaaggtaaaagtggaactgaaagaatccaaagttggactattcaatgcagagctgttggaagcgctcctcaactattacatccttaacaccttctaccccaagttcaatgataagttggccgaaggcttcccccttcctctgctgaagcgtgttcagctctacgaccttgggctgcagatccataaggacttcctgttcttgggtgccaatgtccaatacatgagagtttgaggacaagaaagatgaagcttggaggtcacagctggatctgcttgttgcatttccagctgtgcagcacgtctcagagattcttgaagaatgaagacatttctgctctcagctccgggggtgaggtgtgcctggcctctgcctccaccctcctcctcttcaccaggtgcatgcatgccctctctgagtctggactttgcttcccctccaggagggaccaccctccctgactggcctgggatatctttacaagcaggcactgtatttttttattcgccatctgatccccatgcctagcagagtgctggcacttagtaggtcctcaataaatatttattaaatgatgagatgatggaa

SEQ ID NO: 16429 - DNA, 1587 bp, Homo sapiens
gggacagtcctggcccactgcactgggaatctaggatgggggccttggccagagccctgccgtccatactgctggcattgctgcttacgtccaccccagaggctctgggtgccaaccccggcttggtcgccaggatcaccgacaagggactgcagtatgcggcccaggaggggctattggctctgcagagtgagctgctcaggatcacgctgcctgacttcaccggggacttgaggatcccccacgtcggccgtgggcgctatgagttccacagcctgaacatccacagctgtgagctgcttcactctgcgctgaggcctgtccctggccagggcctgagtctcagcatctccgactcctccatccgggtccagggcaggtggaaggtgcgcaagtcattcttcaaactacagggctcctttgatgtcagtgtcaagggcatcagcatttcggtcaacctcctgttgggcagcgagtcctccgggaggcccacagttactgcctccagctgcagcagtgacatcgctgacgtggaggtggacatgtcgggagacttggggtggctgttgaacctcttccacaaccagattgagtccaagttccagaaagtactggagagcaggatttgcgaaatgatccagaaatcggtgtcctccgatctacagccttatctccaaactctgccagttacaacagagattgacagtttcgccgacattgattatagcttagtggaagcccctcgggcaacagcccagatgctggaggtgatgtttaagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatgataccgcctgactctaatatccgactgaccaccaagtccttccgacccttcgtcccacggttagccaggctctaccccaacatgaacctggaactccagggatcagtgccctctgctccgctcctgaacttcagccctgggaatctgtctgtggacccctatatggagatagatgcctttgtgctcctgcccagctccagcaaggagcctgtcttccggctcagtgtggccactaatgtgtccgccaccttgaccttcaataccagcaagatcactgggttcctgaagccaggaaaggtaaaagtggaactgaaagaatccaaagttggactattcaatgcagagctgttggaagcgctcctcaactattacatccttaacaccttctaccccaagttcaatgataagttggccgaaggcttcccccttcctctgctgaagcgtgttcagctctacgaccttgggctgcagatccataaggacttcccctccaggagggaccaccctccctgactggcctgggatatctttacaagcaggcactgtatttttttattcgccatctgatccccatgcctagcagagtgctggcacttagtaggtcctcaataaatatttattaaatgatgag

SEQ ID NO: 16430 - DNA, 2630 bp, Homo sapiens
gtttctctccctgcccccgcgacttcgcgcaagatccgggaaggacacccgaggcccctgggagaccctggggaggtgaaaatcagagagcgaagcgggccgtggcccctaggcctgacccctccccgcggggtaaggcgggcaccccgcgagcgcaggggtcctcttactgctgatggcacccagctctgggcccagacgccgctcaccgtccaccgccggtgctgggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaactatttatgagttcttttggtgtgaagaaagggctcatgttgcatttccagccattgctacaaagaacctttatttgttcagtaacggtagaaaatccttcccgattaaaaacttcagacttgctgaatatcctgcaatgtcaagatgaccgatgttgagttgggtggatttgctaacgagtcagatttgaacatgaggctattggaacccaataggcgtcattgatggcggcaagccatagctttcaagttttaataaaatgcacaaaag

SEQ ID NO: 16431 - DNA, 1573 bp, Homo sapiens
gagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctgggtgtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcactt

SEQ ID NO: 16432 - DNA, 2565 bp, Homo sapiens
ccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggcaggagtgcagtggtacgatcgtagctctccgcagctttgatctcctgggctcctgcaatccgcccagctcagcctcctgagtacctgggaccacaggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaactatttatgagttcttttggtgtgaagaaagggctcatgttgcatttccagccattgctacaaagaacctttatttgttcagtaacggtagaaaatccttcccgattaaaaacttcagacttgctgaatatcctgcaatgtcaagatgaccgatgttgagttgggtggatttgctaacgagtcagatttgaacatgaggctattggaacccaataggcgtcattgatggcggcaagccatagctttcaagttttaataaaatgcacaaaag

SEQ ID NO: 16433 - DNA, 2357 bp, Homo sapiens
gctaaaaactttaccatcttcccagttcactcccagtcggtcttaggagacaggaccgctattgtgcccattttgcagacaggaagccgagctcagagaggatgggtaacatgcccgaaggcacagagagtgtcttggtctgtccggacgcgtctgtagagttacaggaagagaagggccgccctccagagggccgggagcgccccagcgcgggtccggggtcgaggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 16434 - DNA, 6414 bp, Homo sapiens
ctgggattgggacacactttctgggcactgctggccagtcccaaaatggaacataaggaagtggttcttctacttcttttatttctgaaatcagcagcacctgagcaaagccatgtggtccaggattgctaccatggtgatggacagagttatcgaggcacgtactccaccactgtcacaggaaggacctgccaagcttggtcatctatgacaccacatcaacataataggaccacagaaaactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatcctgtggcagccccttattgttatacgagggatcccagtgtcaggtgggagtactgcaacctgacacaatgctcagacgcagaagggactgccgtcgcgcctccaactattaccccgattccaagcctagaggctccttctgaacaagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgctggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgctggcctgaccaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagatccaagcacagaggcttcttctgaagaagcaccaacggagcaaagccccggggtccaggattgctaccatggtgatggacagagttatcgaggctcattctctaccactgtcacaggaaggacatgtcagtcttggtcctctatgacaccacactggcatcagaggacaacagaatattatccaaatggtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatggtggcctgaccaggaactactgcaggaatccagatgctgagattcgcccttggtgttataccatggatcccagtgtcagatgggagtactgcaacctgacgcaatgtccagtgatggaatcaactctcctcacaactcccacggtggtcccagttccaagcacagagcttccttctgaagaagcaccaactgaaaacagcactggggtccaggactgctaccgaggtgatggacagagttatcgaggcacactctccaccactatcacaggaagaacatgtcagtcttggtcgtctatgacaccacattggcatcggaggatcccattatactatccaaatgctggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaagcaccacctgagaaaagccctgtggtccaggattgctaccatggtgatggacggagttatcgaggcatatcctccaccactgtcacaggaaggacctgtcaatcttggtcatctatgataccacactggcatcagaggaccccagaaaactacccaaatgctggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcatggaggctcattctgaagcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgatggcctgacaatgaactactgcaggaatccagatgccgatacaggcccttggtgttttaccatggaccccagcatcaggtgggagtactgcaacctgacgcgatgctcagacacagaagggactgtggtcgctcctccgactgtcatccaggttccaagcctagggcctccttctgaacaagactgtatgtttgggaatgggaaaggataccggggcaagaaggcaaccactgttactgggacgccatgccaggaatgggctgcccaggagccccatagacacagcacgttcattccagggacaaataaatgggcaggtctggaaaaaaattactgccgtaaccctgatggtgacatcaatggtccctggtgctacacaatgaatccaagaaaactttttgactactgtgatatccctctctgtgcatcctcttcatttgattgtgggaagcctcaagtggagccgaagaaatgtcctggaagcattgtaggggggtgtgtggcccacccacattcctggccctggcaagtcagtctcagaacaaggtttggaaagcacttctgtggaggcaccttaatatccccagagtgggtgctgactgctgctcactgcttgaagaagtcctcaaggccttcatcctacaaggtcatcctgggtgcacaccaagaagtgaacctcgaatctcatgttcaggaaatagaagtgtctaggctgttcttggagcccacacaagcagatattgccttgctaaagctaagcaggcctgccgtcatcactgacaaagtaatgccagcttgtctgccatccccagactacatggtcaccgccaggactgaatgttacatcactggctggggagaaacccaaggtacctttgggactggccttctcaaggaagcccagctccttgttattgagaatgaagtgtgcaatcactataagtatatttgtgctgagcatttggccagaggcactgacagttgccagggtgacagtggagggcctctggtttgcttcgagaaggacaaatacattttacaaggagtcacttcttggggtcttggctgtgcacgccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttga

SEQ ID NO: 16435 - DNA, 6490 bp, Homo sapiens
aggtacctttggggctggctttctcaaggaagcccagctccctgtgattgagaatgaagtgtgcaatcgcaatgtcctgggattgggacacactttctgggcactgctggccagtcccaaaatggaacataaggaagtggttcttctacttcttttatttctgaaatcagcagcacctgagcaaagccatgtggtccaggattgctaccatggtgatggacagagttatcgaggcacgtactccaccactgtcacaggaaggacctgccaagcttggtcatctatgacaccacatcaacataataggaccacagaaaactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatcctgtggcagccccttattgttatacgagggatcccagtgtcaggtgggagtactgcaacctgacacaatgctcagacgcagaagggactgccgtcgcgcctccaactattaccccgattccaagcctagaggctccttctgaacaagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgctggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgctggcctgaccaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagatccaagcacagaggcttcttctgaagaagcaccaacggagcaaagccccggggtccaggattgctaccatggtgatggacagagttatcgaggctcattctctaccactgtcacaggaaggacatgtcagtcttggtcctctatgacaccacactggcatcagaggacaacagaatattatccaaatggtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatggtggcctgaccaggaactactgcaggaatccagatgctgagattcgcccttggtgttataccatggatcccagtgtcagatgggagtactgcaacctgacgcaatgtccagtgatggaatcaactctcctcacaactcccacggtggtcccagttccaagcacagagcttccttctgaagaagcaccaactgaaaacagcactggggtccaggactgctaccgaggtgatggacagagttatcgaggcacactctccaccactatcacaggaagaacatgtcagtcttggtcgtctatgacaccacattggcatcggaggatcccattatactatccaaatgctggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaagcaccacctgagaaaagccctgtggtccaggattgctaccatggtgatggacggagttatcgaggcatatcctccaccactgtcacaggaaggacctgtcaatcttggtcatctatgataccacactggcatcagaggaccccagaaaactacccaaatgctggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcatggaggctcattctgaagcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgatggcctgacaatgaactactgcaggaatccagatgccgatacaggcccttggtgttttaccatggaccccagcatcaggtgggagtactgcaacctgacgcgatgctcagacacagaagggactgtggtcgctcctccgactgtcatccaggttccaagcctagggcctccttctgaacaagactgtatgtttgggaatgggaaaggataccggggcaagaaggcaaccactgttactgggacgccatgccaggaatgggctgcccaggagccccatagacacagcacgttcattccagggacaaataaatgggcaggtctggaaaaaaattactgccgtaaccctgatggtgacatcaatggtccctggtgctacacaatgaatccaagaaaactttttgactactgtgatatccctctctgtgcatcctcttcatttgattgtgggaagcctcaagtggagccgaagaaatgtcctggaagcattgtaggggggtgtgtggcccacccacattcctggccctggcaagtcagtctcagaacaaggtttggaaagcacttctgtggaggcaccttaatatccccagagtgggtgctgactgctgctcactgcttgaagaagtcctcaaggccttcatcctacaaggtcatcctgggtgcacaccaagaagtgaacctcgaatctcatgttcaggaaatagaagtgtctaggctgttcttggagcccacacaagcagatattgccttgctaaagctaagcaggcctgccgtcatcactgacaaagtaatgccagcttgtctgccatccccagactacatggtcaccgccaggactgaatgttacatcactggctggggagaaacccaaggtacctttgggactggccttctcaaggaagcccagctccttgttattgagaatgaagtgtgcaatcactataagtatatttgtgctgagcatttggccagaggcactgacagttgccagggtgacagtggagggcctctggtttgcttcgagaaggacaaatacattttacaaggagtcacttcttggggtcttggctgtgcacgccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttga

SEQ ID NO: 16436 - DNA, 4775 bp, Homo sapiens
acacaaactctggaaaagatgaaatgaggtcgagagggacattaggtggcatctggaggagtaggacatgatggggaaagaggatgtgtggaggaggagggctttgggggtgttgtaaccaggaaggggaggagggggtgggatattatgatgcagctcacattgaacactctctttcctgttgtttccacaccagctattacgtatattgtcaccgtcttcactggggatgtccggggggctggtaccaaatccaaaatctacttggtcatgtatggggccagagggaataagaacagtgggaaaatcttcctggagggcggcgtgtttgaccgaggccgcacggacatcttccacatcgagctggctgtcctccttagccccctgagtcgggtctccgtcgggcatggcaatgtgggtgtcaacagaggctggttctgtgagaaggtggtgattctgtgccccttcactggtatccagcagaccttcccttgtagcaactggctggatgagaagaaagcggatgggttgattgagaggcagctctatgagatggtgtctctcaggaagaagcggctgaaaaaattcccttggtccctgtgggtctggacaaccgacctaaagaaagctggtaccaactctcccatcttcatccagatttatgggcagaaggggcggacagatgagattctcctgaatcccaacaacaagtggttcaaacccggcataatcgagaagtttaggattgagctcccggatcttggcaggttttataagattcgagtatggcatgataaaaggagttctggttctggatggcatttagaaaggatgaccctgatgaacactctgaacaaagacaagtacaacttcaattgcaaccgctggctggatgccaatgaggatgacaatgagatagtgagggaaatgactgcagaaggcccaacagtgcgcaggatcatgggcatggcccggtaccatgtgactgtgtgcacaggtgaacttgaaggtgctgggaccgatgccaacgtctatctctgcctttttggtgatgtgggggacacgggggaacggctgctctacaactgcaggaataacacagacctgtttgaaaagggcaatgctgacgagttcactatcgagtctgtcaccatgcggaatgtgaggcgggtgaggatcagacacgatggcaaaggctccggcagcggctggtacctggacagagtgctggtgagagaggaggggcagcctgagagcgacaacgtggagttcccatgtctcaggtggttggacaaggataaggatgatgggcagctggtccgagagttgctacccagtgacagcagcgcgacactgaagaactttcgctatcacatcagcttgaagactggggatgtctctggggccagcacggattctagagtctacatcaagctctatggggataaatctgacaccatcaagcaagttcttcttgtctctgacaacaacctcaaagactactttgaacgtggccgggtggatgagttcaccctcgagaccctgaacattggaaatatcaaccggctggtgattgggcatgacagcactggcatgcatgccagctggttcctgggcagcgttcagatccgtgtgccccgtcaaggcaagcagtacacctttcccgccaaccgctggctggacaagaaccaggctgacgggcgcctggaggtggagctgtatcccagcgaggtggtggagatccagaaattggtccactatgaggttgagatttggacaggagatgtgggtggcgcaggcaccagtgcccgagtctacatgcagatctatggagagaaaggcaagacagaagtgctcttcctctccagccgctcaaaagtttttgaacgggcgtccaaggacacattccagcttgaggcggccgacgtgggcgaggtctataagctccggctcgggcacacgggcgagggctttgggcccagctggttcgtggacaccgtgtggctgcggcacctggtggtgcgggaggtggacctcacgccggaggaggaggcccggaagaagaaggagaaggacaagctgcggcagctgctcaagaaggagcggctgaaggccaagctgcagaggaagaagaagaagaggaagggcagcgacgaagaggacgagggggaggaagaggagtcgtcctcatcagaggagtcctcgtcagaggaggaggagatggaagaagaggaggaagaggaggagtttgggccggggatgcaggaggtgattgagcagcacaagttcgaagcccaccgctggctggcccggggcaaggaggacaacgaacttgtcgtggagttggtgccagctggcaagccgggtcctgagcgaaacacctatgaggttcaggtggtcacggggaatgtgcccaaggccggcactgatgctaacgtctacctaaccatctacggcgaggagtatggagacacgggcgaacgacccctgaagaagtcagacaagtccaacaaatttgagcaggggcagacagacaccttcaccatctatgccattgacctgggggccctgaccaagattcggattcgccacgacaacacaggcaacagagcaggctggttcctggacagaatagacattactgacatgaacaacgagatcacgtactactttccatgccaacgttggctggcagtggaggaagatgatggccagctgtccagggagctgttgccagtggatgagtcctatgtgctgccacagagcgaggagggtaggggaggcggtgacaacaaccccctcgacaacctggccctggagcagaaagataaatctaccacattctcagtgaccataaagactggggttaagaagaatgcgggcacagatgctaatgtcttcatcacactctttggcacacaggatgacactggaatgaccctcctgaagtcctccaagacaaacagcgataagtttgagagggacagcattgaaatcttcacggtggagacgctggatctgggagacctgtggaaagtccggcttggccatgacaacacaggcaaggccccaggctggtttgtagactgggtagaggtggatgccccatctcttgggaagtgcatgacgtttccctgtggccgctggctggccaaaaacgaagacgacgggtccatcatcagagacctcttccatgcagagcttcagacgaggctgtacacaccatttgttccttacgagatcaccctctacaccagtgatgtctttgctgctgggacagatgccaacatcttcatcatcatctatggctgcgatgccgtgtgcacccagcagaagtatctgtgtaccaacaagagggaacagaagcagttctttgagaggaagtctgcctcccgcttcatcgtagagttagaagatgtgggagaaatcattgaaaaaattcggattggccataataacacgggcatgaatcctgggtggcactgctctcacgtggacatccgcaggctcctcccggataaagacggtgcagagaccttgactttcccatgcgatcggtggcttgccacctctgaggatgacaaaaagaccattcgagaactggttccatatgacatcttcactgagaaatacatgaaagatgggtccttacggcaagtctacaaggaagtagaagagcctctggacattgtgctgtactcggtgcagatcttcacagggaacattcctggggcagggacggatgccaaggtgtacatcaccatctatggagacctcggggacactggggagcgataccttggcaagtcagagaaccggaccaacaagttcgagagaggaacggctgacaccttcatcatcgaggccgctgacctaggcgtcatctacaagatcaagctccgccatgacaactccaagtggtgcgcagactggtacgtggagaaggtggagatctggaatgacaccaacgaggacgagttcctgttcctatgcgggcgctggctctccctgaagaaggaggatgggcgactcgagaggctcttttacgagaaggagtacactggggaccgcagcagcaactgcagcagccctgctgacttctgggagatcgccctgagctccaagatggccgatgtcgacatcagcacagtgaccgggcccatggctgactacgttcaagagggcccaattattccctactatgtgtcagtcaccactgggaagcacaaggacgcggccactgacagccgagccttcatctttctcatcggggaggatgatgaacgtagtaagcgcatctggttggactacccccgagggaagaggggcttcagccgtggctctgtggaggagttctacgtcgcaggcttggatgtgggcatcatcaagaaaatagaggttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagagggtaaaatgtctagaccctcactcttccttccagccaccacccaccccttcccctggttcctctggcttgtcaatggaccttgttaaagcacaaatgtcactgtagaggatcattacatgaacccagcccat

SEQ ID NO: 16437 - DNA, 6202 bp, Homo sapiens
acacaaactctggaaaagatgaaatgaggtcgagagggacattaggtggcatctggaggagtaggacatgatggggaaagaggatgtgtggaggaggagggctttgggggtgttgtaaccaggaaggggaggagggggtgggatattatgatgcagctcacattgaacactctctttcctgttgtttccacaccagctattacgtatattgtcaccgtcttcactggggatgtccggggggctggtaccaaatccaaaatctacttggtcatgtatggggccagagggaataagaacagtgggaaaatcttcctggagggcggcgtgtttgaccgaggccgcacggacatcttccacatcgagctggctgtcctccttagccccctgagtcgggtctccgtcgggcatggcaatgtgggtgtcaacagaggctggttctgtgagaaggtggtgattctgtgccccttcactggtatccagcagaccttcccttgtagcaactggctggatgagaagaaagcggatgggttgattgagaggcagctctatgagatggtgtctctcaggaagaagcggctgaaaaaattcccttggtccctgtgggtctggacaaccgacctaaagaaagctggtaccaactctcccatcttcatccagatttatgggcagaaggggcggacagatgagattctcctgaatcccaacaacaagtggttcaaacccggcataatcgagaagtttaggattgagctcccggatcttggcaggttttataagattcgagtatggcatgataaaaggagttctggttctggatggcatttagaaaggatgaccctgatgaacactctgaacaaagacaagtacaacttcaattgcaaccgctggctggatgccaatgaggatgacaatgagatagtgagggaaatgactgcagaaggcccaacagtgcgcaggatcatgggcatggcccggtaccatgtgactgtgtgcacaggtgaacttgaaggtgctgggaccgatgccaacgtctatctctgcctttttggtgatgtgggggacacgggggaacggctgctctacaactgcaggaataacacagacctgtttgaaaagggcaatgctgacgagttcactatcgagtctgtcaccatgcggaatgtgaggcgggtgaggatcagacacgatggcaaaggctccggcagcggctggtacctggacagagtgctggtgagagaggaggggcagcctgagagcgacaacgtggagttcccatgtctcaggtggttggacaaggataaggatgatgggcagctggtccgagagttgctacccagtgacagcagcgcgacactgaagaactttcgctatcacatcagcttgaagactggggatgtctctggggccagcacggattctagagtctacatcaagctctatggggataaatctgacaccatcaagcaagttcttcttgtctctgacaacaacctcaaagactactttgaacgtggccgggtggatgagttcaccctcgagaccctgaacattggaaatatcaaccggctggtgattgggcatgacagcactggcatgcatgccagctggttcctgggcagcgttcagatccgtgtgccccgtcaaggcaagcagtacacctttcccgccaaccgctggctggacaagaaccaggctgacgggcgcctggaggtggagctgtatcccagcgaggtggtggagatccagaaattggtccactatgaggttgagatttggacaggagatgtgggtggcgcaggcaccagtgcccgagtctacatgcagatctatggagagaaaggcaagacagaagtgctcttcctctccagccgctcaaaagtttttgaacgggcgtccaaggacacattccagcttgaggcggccgacgtgggcgaggtctataagctccggctcgggcacacgggcgagggctttgggcccagctggttcgtggacaccgtgtggctgcggcacctggtggtgcgggaggtggacctcacgccggaggaggaggcccggaagaagaaggagaaggacaagctgcggcagctgctcaagaaggagcggctgaaggccaagctgcagaggaagaagaagaagaggaagggcagcgacgaagaggacgagggggaggaagaggagtcgtcctcatcagaggagtcctcgtcagaggaggaggagatggaagaagaggaggaagaggaggagtttgggccggggatgcaggaggtgattgagcagcacaagttcgaagcccaccgctggctggcccggggcaaggaggacaacgaacttgtcgtggagttggtgccagctggcaagccgggtcctgagcgaaacacctatgaggttcaggtggtcacggggaatgtgcccaaggccggcactgatgctaacgtctacctaaccatctacggcgaggagtatggagacacgggcgaacgacccctgaagaagtcagacaagtccaacaaatttgagcaggggcagacagacaccttcaccatctatgccattgacctgggggccctgaccaagattcggattcgccacgacaacacaggcaacagagcaggctggttcctggacagaatagacattactgacatgaacaacgagatcacgtactactttccatgccaacgttggctggcagtggaggaagatgatggccagctgtccagggagctgttgccagtggatgagtcctatgtgctgccacagagcgaggagggtaggggaggcggtgacaacaaccccctcgacaacctggccctggagcagaaagataaatctaccacattctcagtgaccataaagactggggttaagaagaatgcgggcacagatgctaatgtcttcatcacactctttggcacacaggatgacactggaatgaccctcctgaagtcctccaagacaaacagcgataagtttgagagggacagcattgaaatcttcacggtggagacgctggatctgggagacctgtggaaagtccggcttggccatgacaacacaggcaaggccccaggctggtttgtagactgggtagaggtggatgccccatctcttgggaagtgcatgacgtttccctgtggccgctggctggccaaaaacgaagacgacgggtccatcatcagagacctcttccatgcagagcttcagacgaggctgtacacaccatttgttccttacgagatcaccctctacaccagtgatgtctttgctgctgggacagatgccaacatcttcatcatcatctatggctgcgatgccgtgtgcacccagcagaagtatctgtgtaccaacaagagggaacagaagcagttctttgagaggaagtctgcctcccgcttcatcgtagagttagaagatgtgggagaaatcattgaaaaaattcggattggccataataacacgggcatgaatcctgggtggcactgctctcacgtggacatccgcaggctcctcccggataaagacggtgcagagaccttgactttcccatgcgatcggtggcttgccacctctgaggatgacaaaaagaccattcgagaactggttccatatgacatcttcactgagaaatacatgaaagatgggtccttacggcaagtctacaaggaagtagaagagcctctggacattgtgctgtactcggtgcagatcttcacagggaacattcctggggcagggacggatgccaaggtgtacatcaccatctatggagacctcggggacactggggagcgataccttggcaagtcagagaaccggaccaacaagttcgagagaggaacggctgacaccttcatcatcgaggccgctgacctaggcgtcatctacaagatcaagctccgccatgacaactccaagtggtgcgcagactggtacgtggagaaggtggagatctggaatgacaccaacgaggacgagttcctgttcctatgcgggcgctggctctccctgaagaaggaggatgggcgactcgagaggctcttttacgagaaggagtacactggggaccgcagcagcaactgcagcagccctgctgacttctgggagatcgccctgagctccaagatggccgatgtcgacatcagcacagtgaccgggcccatggctgactacgttcaagagggcccaattattccctactatgtgtcagtcaccactgggaagcacaaggacgcggccactgacagccgagccttcatctttctcatcggggaggatgatgaacgtagtaagcgcatctggttggactacccccgagggaagaggggcttcagccgtggctctgtggaggagttctacgtcgcaggcttggatgtgggcatcatcaagaaaatagagctgggccatgacggggcctcccctgagagctgctggctggtggaagagttgtgtttggcagtgcccacccagggcaccaagtacatgttgaactgtaactgctggctggccaaggacagaggcgacggcatcacctcccgtgtcttcgacctcttggatgccatggtggtgaacattggggtgaaggttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaagggatatttcctggctggcatctgagctatgtcgatgtgaaggacaactcccgcgacgagaccttccacttccagtgtgactgctggctctccaagagtgagggtgacgggcagacggtccgcgactttgcctgtgccaacaacaagatctgtgatgagctggaagagaccacctacgagatcgtcatagaaacgggcaacggaggcgaaaccagggagaacgtctggctcatcctggagggcaggaagaaccgatccaaagagtttctcatggaaaattcttctaggcagcgggcctttaggaaggggaccacagacacgtttgagtttgacagcatctacttgggggacattgcctccctctgtgtgggccaccttgccagggaagaccggtttatccccaagagagaacttgcctggcatgtcaagaccatcaccatcaccgagatggagtacggcaatgtgtacttctttaactgtgactgcctcatccccctcaagaggaagaggaagtacttcaaggtattcgaggttaccaagacgacagagagctttgccagcaaggtccagagcctggtgcccgtcaagtacgaagtcatcgtgacaacaggctatgagccaggggcaggcactgatgccaacgtcttcgtgaccatctttggggccaacggagacacaggcaagcgggagctgaagcagaaaatgcgcaacctcttcgagcggggcagcacagaccgcttcttcctggagacgctggagctggtagtgaccaggctgggacttgctgcagagtgtggatgagaaattgagtcttcacccaggggatagaagtggagaagcagaggccatcaagatggtgtattttaagcaaaaactaattaacacttttccccaaaaaagctaggctaattaaattattaccaaccatatcctataaagaactcatcttagcatctgcttgctaagaagtgtatacttttccccagtttcaataaacccagtggcaagtgga

SEQ ID NO: 16438 - DNA, 3755 bp, Homo sapiens
gatactttgtggaggggttatgagagaattgcaggcagggccccagcacctagagcccatgggccagctgacccacaggaacaaacagagaatggcgttgagtggcagatgctgaggcacttgacagacaccttcaccatctatgccattgacctgggggccctgaccaagattcggattcgccacgacaacacaggcaacagagcaggctggttcctggacagaatagacattactgacatgaacaacgagatcacgtactactttccatgccaacgttggctggcagtggaggaagatgatggccagctgtccagggagctgttgccagtggatgagtcctatgtgctgccacagagcgaggagggtaggggaggcggtgacaacaaccccctcgacaacctggccctggagcagaaagataaatctaccacattctcagtgaccataaagactggggttaagaagaatgcgggcacagatgctaatgtcttcatcacactctttggcacacaggatgacactggaatgaccctcctgaagtcctccaagacaaacagcgataagtttgagagggacagcattgaaatcttcacggtggagacgctggatctgggagacctgtggaaagtccggcttggccatgacaacacaggcaaggccccaggctggtttgtagactgggtagaggtggatgccccatctcttgggaagtgcatgacgtttccctgtggccgctggctggccaaaaacgaagacgacgggtccatcatcagagacctcttccatgcagagcttcagacgaggctgtacacaccatttgttccttacgagatcaccctctacaccagtgatgtctttgctgctgggacagatgccaacatcttcatcatcatctatggctgcgatgccgtgtgcacccagcagaagtatctgtgtaccaacaagagggaacagaagcagttctttgagaggaagtctgcctcccgcttcatcgtagagttagaagatgtgggagaaatcattgaaaaaattcggattggccataataacacgggcatgaatcctgggtggcactgctctcacgtggacatccgcaggctcctcccggataaagacggtgcagagaccttgactttcccatgcgatcggtggcttgccacctctgaggatgacaaaaagaccattcgagaactggttccatatgacatcttcactgagaaatacatgaaagatgggtccttacggcaagtctacaaggaagtagaagagcctctggacattgtgctgtactcggtgcagatcttcacagggaacattcctggggcagggacggatgccaaggtgtacatcaccatctatggagacctcggggacactggggagcgataccttggcaagtcagagaaccggaccaacaagttcgagagaggaacggctgacaccttcatcatcgaggccgctgacctaggcgtcatctacaagatcaagctccgccatgacaactccaagtggtgcgcagactggtacgtggagaaggtggagatctggaatgacaccaacgaggacgagttcctgttcctatgcgggcgctggctctccctgaagaaggaggatgggcgactcgagaggctcttttacgagaaggagtacactggggaccgcagcagcaactgcagcagccctgctgacttctgggagatcgccctgagctccaagatggccgatgtcgacatcagcacagtgaccgggcccatggctgactacgttcaagagggcccaattattccctactatgtgtcagtcaccactgggaagcacaaggacgcggccactgacagccgagccttcatctttctcatcggggaggatgatgaacgtagtaagcgcatctggttggactacccccgagggaagaggggcttcagccgtggctctgtggaggagttctacgtcgcaggcttggatgtgggcatcatcaagaaaatagaggttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaagggatatttcctggctggcatctgagctatgtcgatgtgaaggacaactcccgcgacgagaccttccacttccagtgtgactgctggctctccaagagtgagggtgacgggcagacggtccgcgactttgcctgtgccaacaacaagatctgtgatgagctggaagagaccacctacgagatcgtcatagaaacgggcaacggaggcgaaaccagggagaacgtctggctcatcctggagggcaggaagaaccgatccaaagagtttctcatggaaaattcttctaggcagcgggcctttaggaaggggaccacagacacgtttgagtttgacagcatctacttgggggacattgcctccctctgtgtgggccaccttgccagggaagaccggtttatccccaagagagaacttgcctggcatgtcaagaccatcaccatcaccgagatggagtacggcaatgtgtacttctttaactgtgactgcctcatccccctcaagaggaagaggaagtacttcaaggtattcgaggttaccaagacgacagagagctttgccagcaaggtccagagcctggtgcccgtcaagtacgaagtcatcgtgacaacaggctatgagccaggggcaggcactgatgccaacgtcttcgtgaccatctttggggccaacggagacacaggcaagcgggagctgaagcagaaaatgcgcaacctcttcgagcggggcagcacagaccgcttcttcctggagacgctggagctgggtgagctgcgcaaggtgcgcctggagcacgacagcagtggctactgctcaggctggctggtggagaaggtggaggtcaccaacaccagcaccggcgtggccaccatcttcaactgtggcaggtggctggacaagaagcggggggatggactcacctggagagacctcttcccttctgtctgaggggctagggcccccaccctctcactgagatgccccaatctcacatttctgccctccaccttggcggtcagcagcccttcaaagcctctagcattggcactgggggctagcagtccactgagaacttcatggggtcctgctccccaccctacccccagtttattgaacctacagtgataataattagcatgtgtcataatctgtggctgccc

SEQ ID NO: 16439 - DNA, 1358 bp, Homo sapiens
gaaccagggtcctgacctggagtctgacctctgccagaaactcatcaggtcaccctggacaagtcatgccatctttatgggcttttgtttcctcttctgataaatgggcttaatgttgccagcctaacttcttaagatgttctgaaaatccaaggcatttaagcttggaaaggaaaaagtgccacagaaccatgaggctggggacaaactgtgaacatccccagcttccccttgcagctccatcagggtactactttccatgccaacgttggctggcagtggaggaagatgatggccagctgtccagggagctgttgccagtggatgagtcctatgtgctgccacagagcgaggagggtaggggaggcggtgacaacaaccccctcgacaacctggccctggagcagaaagataaatctaccacattctcagtgaccataaagactggggttaagaagaatgcgggcacagatgctaatgtcttcatcacactctttggcacacaggatgacactggaatgaccctcctgaagtcctccaagacaaacagcgataagtttgagagggacagcattgaaatcttcacggtggagacgctggatctgggagacctgtggaaagtccggcttggccatgacaacacaggcaaggccccaggctggtttgtagactgggtagaggtggatgccccatctcttgggaagtgcatgacgtttccctgtggccgctggctggccaaaaacgaagacgacgggtccatcatcagagacctcttccatgcagagcttcagacgaggctgtacacaccatttgttccttacgagatcaccctctacaccagtgatgtctttgctgctgggacagatgccaacatcttcatcatcatctatggctgcgatgccgtgtgcacccagcagaagtatctgtgtaccaacaagagggaacagaagcagttctttgagaggaagtctgcctcccgcttcatcgtagagttagaagatgtgggagaaatcattgaaaaaattcggattggccataataacacgggcatgaatcctgggtggcactgctctcacgtggacatccgcaggctcctcccggataaagactagagatggggtttcaccatgttggccaagctggtcttgaaatcctgacatcagggtgcagagaccttgactttcccatgcgatcggtggcttgccacctctgaggatgacaaaaagaccattcgagaactggttccatatgacatcttcactgagaaatacatgaaagatgggtccttacggcaagtctacaaggaagtagaagagcctctggacattgtgctgtactcggtgcagatcttcacaggg

SEQ ID NO: 16440 - DNA, 6848 bp, Homo sapiens
atgatgccccagaagaaaaggcggaggaagaaggacatcgacttcctggccctgtacgaagcggagctgctgaactacgcctcggaggacgacgagggggagctggaacacgagtactacaaggccagagtgtatgaagtggtcacagccacgggggatgttcgcggtgcagggacggatgccaatgtcttcatcacgctttttggagagaatgggctctctcccaagctccagctcaccagcaagagcaagtctgcctttgagaagggcaacgtcgatgtgttccgggtgagaaccaacaatgtgggcctcatctataaagtcaggattgagcatgacaacacgggcttgaatgccagctggtacctggaccatgtgattgtgaccgacatgaagaggcctcatctccgttactacttcaactgcaacaactggctgagcaaggtggaaggtgaccgccagtggtgccgtgacctgctggccagcttcaaccccatggacatgcccagaggtaataagtatgaagtcaaggtatacactggtgatgtaattggtgcagggacagatgctgatgtcttcatcaatatttttggagagtatggagacacaggggagcgtaggctagaaaatgaaaaggacaactttgaaaagggagctgaagacaggttcatcctggatgccccggatttggggcagctgatgaagatcaatgttggccacaacaataaggggggctctgcaggttggttcctgtcccagatagtcattgaagatattgggaacaaaagaaaatatgacttcccccttaaccgctggctggccttggacgaagacgatggcaaaatccaaagggatatcttagtgggcggagctgagaccacagctattacgtatattgtcaccgtcttcactggggatgtccggggggctggtaccaaatccaaaatctacttggtcatgtatggggccagagggaataagaacagtgggaaaatcttcctggagggcggcgtgtttgaccgaggccgcacggacatcttccacatcgagctggctgtcctccttagccccctgagtcgggtctccgtcgggcatggcaatgtgggtgtcaacagaggctggttctgtgagaaggtggtgattctgtgccccttcactggtatccagcagaccttcccttgtagcaactggctggatgagaagaaagcggatgggttgattgagaggcagctctatgagatggtgtctctcaggaagaagcggctgaaaaaattcccttggtccctgtgggtctggacaaccgacctaaagaaagctggtaccaactctcccatcttcatccagatttatgggcagaaggggcggacagatgagattctcctgaatcccaacaacaagtggttcaaacccggcataatcgagaagtttaggattgagctcccggatcttggcaggttttataagattcgagtatggcatgataaaaggagttctggttctggatggcatttagaaaggatgaccctgatgaacactctgaacaaagacaagtacaacttcaattgcaaccgctggctggatgccaatgaggatgacaatgagatagtgagggaaatgactgcagaaggcccaacagtgcgcaggatcatgggcatggcccggtaccatgtgactgtgtgcacaggtgaacttgaaggtgctgggaccgatgccaacgtctatctctgcctttttggtgatgtgggggacacgggggaacggctgctctacaactgcaggaataacacagacctgtttgaaaagggcaatgctgacgagttcactatcgagtctgtcaccatgcggaatgtgaggcgggtgaggatcagacacgatggcaaaggctccggcagcggctggtacctggacagagtgctggtgagagaggaggggcagcctgagagcgacaacgtggagttcccatgtctcaggtggttggacaaggataaggatgatgggcagctggtccgagagttgctacccagtgacagcagcgcgacactgaagaactttcgctatcacatcagcttgaagactggggatgtctctggggccagcacggattctagagtctacatcaagctctatggggataaatctgacaccatcaagcaagttcttcttgtctctgacaacaacctcaaagactactttgaacgtggccgggtggatgagttcaccctcgagaccctgaacattggaaatatcaaccggctggtgattgggcatgacagcactggcatgcatgccagctggttcctgggcagcgttcagatccgtgtgccccgtcaaggcaagcagtacacctttcccgccaaccgctggctggacaagaaccaggctgacgggcgcctggaggtggagctgtatcccagcgaggtggtggagatccagaaattggtccactatgaggttgagatttggacaggagatgtgggtggcgcaggcaccagtgcccgagtctacatgcagatctatggagagaaaggcaagacagaagtgctcttcctctccagccgctcaaaagtttttgaacgggcgtccaaggacacattccagcttgaggcggccgacgtgggcgaggtctataagctccggctcgggcacacgggcgagggctttgggcccagctggttcgtggacaccgtgtggctgcggcacctggtggtgcgggaggtggacctcacgccggaggaggaggcccggaagaagaaggagaaggacaagctgcggcagctgctcaagaaggagcggctgaaggccaagctgcagaggaagaagaagaagaggaagggcagcgacgaagaggacgagggggaggaagaggagtcgtcctcatcagaggagtcctcgtcagaggaggaggagatggaagaagaggaggaagaggaggagtttgggccggggatgcaggaggtgattgagcagcacaagttcgaagcccaccgctggctggcccggggcaaggaggacaacgaacttgtcgtggagttggtgccagctggcaagccgggtcctgagcgaaacacctatgaggttcaggtggtcacggggaatgtgcccaaggccggcactgatgctaacgtctacctaaccatctacggcgaggagtatggagacacgggcgaacgacccctgaagaagtcagacaagtccaacaaatttgagcaggggcagacagacaccttcaccatctatgccattgacctgggggccctgaccaagattcggattcgccacgacaacacaggcaacagagcaggctggttcctggacagaatagacattactgacatgaacaacgagatcacgtactactttccatgccaacgttggctggcagtggaggaagatgatggccagctgtccagggagctgttgccagtggatgagtcctatgtgctgccacagagcgaggagggtaggggaggcggtgacaacaaccccctcgacaacctggccctggagcagaaagataaatctaccacattctcagtgaccataaagactggggttaagaagaatgcgggcacagatgctaatgtcttcatcacactctttggcacacaggatgacactggaatgaccctcctgaagtcctccaagacaaacagcgataagtttgagagggacagcattgaaatcttcacggtggagacgctggatctgggagacctgtggaaagtccggcttggccatgacaacacaggcaaggccccaggctggtttgtagactgggtagaggtggatgccccatctcttgggaagtgcatgacgtttccctgtggccgctggctggccaaaaacgaagacgacgggtccatcatcagagacctcttccatgcagagcttcagacgaggctgtacacaccatttgttccttacgagatcaccctctacaccagtgatgtctttgctgctgggacagatgccaacatcttcatcatcatctatggctgcgatgccgtgtgcacccagcagaagtatctgtgtaccaacaagagggaacagaagcagttctttgagaggaagtctgcctcccgcttcatcgtagagttagaagatgtgggagaaatcattgaaaaaattcggattggccataataacacgggcatgaatcctgggtggcactgctctcacgtggacatccgcaggctcctcccggataaagacggtgcagagaccttgactttcccatgcgatcggtggcttgccacctctgaggatgacaaaaagaccattcgagaactggttccatatgacatcttcactgagaaatacatgaaagatgggtccttacggcaagtctacaaggaagtagaagagcctctggacattgtgctgtactcggtgcagatcttcacagggaacattcctggggcagggacggatgccaaggtgtacatcaccatctatggagacctcggggacactggggagcgataccttggcaagtcagagaaccggaccaacaagttcgagagaggaacggctgacaccttcatcatcgaggccgctgacctaggcgtcatctacaagatcaagctccgccatgacaactccaagtggtgcgcagactggtacgtggagaaggtggagatctggaatgacaccaacgaggacgagttcctgttcctatgcgggcgctggctctccctgaagaaggaggatgggcgactcgagaggctcttttacgagaaggagtacactggggaccgcagcagcaactgcagcagccctgctgacttctgggagatcgccctgagctccaagatggccgatgtcgacatcagcacagtgaccgggcccatggctgactacgttcaagagggcccaattattccctactatgtgtcagtcaccactgggaagcacaaggacgcggccactgacagccgagccttcatctttctcatcggggaggatgatgaacgtagtaagcgcatctggttggactacccccgagggaagaggggcttcagccgtggctctgtggaggagttctacgtcgcaggcttggatgtgggcatcatcaagaaaatagaggttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaagggatatttcctggctggcatctgagctatgtcgatgtgaaggacaactcccgcgacgagaccttccacttccagtgtgactgctggctctccaagagtgagggtgacgggcagacggtccgcgactttgcctgtgccaacaacaagatctgtgatgagctggaagagaccacctacgagatcgtcatagaaacgggcaacggaggcgaaaccagggagaacgtctggctcatcctggagggcaggaagaaccgatccaaagagtttctcatggaaaattcttctaggcagcgggcctttaggaaggggaccacagacacgtttgagtttgacagcatctacttgggggacattgcctccctctgtgtgggccaccttgccagggaagaccggtttatccccaagagagaacttgcctggcatgtcaagaccatcaccatcaccgagatggagtacggcaatgtgtacttctttaactgtgactgcctcatccccctcaagaggaagaggaagtacttcaaggtattcgaggttaccaagacgacagagagctttgccagcaaggtccagagcctggtgcccgtcaagtacgaagtcatcgtgacaacaggctatgagccaggggcaggcactgatgccaacgtcttcgtgaccatctttggggccaacggagacacaggcaagcgggagctgaagcagaaaatgcgcaacctcttcgagcggggcagcacagaccgcttcttcctggagacgctggagctgggtgagctgcgcaaggtgcgcctggagcacgacagcagtggctactgctcaggctggctggtggagaaggtggaggtcaccaacaccagcaccggcgtggccaccatcttcaactgtggcaggtggctggacaagaagcggggggatggactcacctggagagacctcttcccttctgtctgaggggctagggcccccaccctctcactgagatgccccaatctcacatttctgccctccaccttggcggtcagcagcccttcaaagcctctagcattggcactgggggctagcagtccactgagaacttcatggggtcctgctccccaccctacccccagtttattgaacctacagtgataataattagcatgtgtcataatctgtggctgccc

SEQ ID NO: 16441 - DNA, 3970 bp, Homo sapiens
agtacctcttcagtaacactgatactttgtggaggggttatgagagaattgcaggcagggccccagcacctagagcccatgggccagctgacccacaggaacaaacagagaatggcgttgagtggcagatgctgaggcacttggttcctggtgtggtctgcttcctcccgtgcatggagcagtgtgtgcattcacatggtgtgatccatatggccctcttcacacctaaatggtgggcaaatccgtcttcagtttctgacagtcactttggatttgcacagcaccagctcatagcagacagacaccttcaccatctatgccattgacctgggggccctgaccaagattcggattcgccacgacaacacaggcaacagagcaggctggttcctggacagaatagacattactgacatgaacaacgagatcacgtactactttccatgccaacgttggctggcagtggaggaagatgatggccagctgtccagggagctgttgccagtggatgagtcctatgtgctgccacagagcgaggagggtaggggaggcggtgacaacaaccccctcgacaacctggccctggagcagaaagataaatctaccacattctcagtgaccataaagactggggttaagaagaatgcgggcacagatgctaatgtcttcatcacactctttggcacacaggatgacactggaatgaccctcctgaagtcctccaagacaaacagcgataagtttgagagggacagcattgaaatcttcacggtggagacgctggatctgggagacctgtggaaagtccggcttggccatgacaacacaggcaaggccccaggctggtttgtagactgggtagaggtggatgccccatctcttgggaagtgcatgacgtttccctgtggccgctggctggccaaaaacgaagacgacgggtccatcatcagagacctcttccatgcagagcttcagacgaggctgtacacaccatttgttccttacgagatcaccctctacaccagtgatgtctttgctgctgggacagatgccaacatcttcatcatcatctatggctgcgatgccgtgtgcacccagcagaagtatctgtgtaccaacaagagggaacagaagcagttctttgagaggaagtctgcctcccgcttcatcgtagagttagaagatgtgggagaaatcattgaaaaaattcggattggccataataacacgggcatgaatcctgggtggcactgctctcacgtggacatccgcaggctcctcccggataaagacggtgcagagaccttgactttcccatgcgatcggtggcttgccacctctgaggatgacaaaaagaccattcgagaactggttccatatgacatcttcactgagaaatacatgaaagatgggtccttacggcaagtctacaaggaagtagaagagcctctggacattgtgctgtactcggtgcagatcttcacagggaacattcctggggcagggacggatgccaaggtgtacatcaccatctatggagacctcggggacactggggagcgataccttggcaagtcagagaaccggaccaacaagttcgagagaggaacggctgacaccttcatcatcgaggccgctgacctaggcgtcatctacaagatcaagctccgccatgacaactccaagtggtgcgcagactggtacgtggagaaggtggagatctggaatgacaccaacgaggacgagttcctgttcctatgcgggcgctggctctccctgaagaaggaggatgggcgactcgagaggctcttttacgagaaggagtacactggggaccgcagcagcaactgcagcagccctgctgacttctgggagatcgccctgagctccaagatggccgatgtcgacatcagcacagtgaccgggcccatggctgactacgttcaagagggcccaattattccctactatgtgtcagtcaccactgggaagcacaaggacgcggccactgacagccgagccttcatctttctcatcggggaggatgatgaacgtagtaagcgcatctggttggactacccccgagggaagaggggcttcagccgtggctctgtggaggagttctacgtcgcaggcttggatgtgggcatcatcaagaaaatagagctgggccatgacggggcctcccctgagagctgctggctggtggaagagttgtgtttggcagtgcccacccagggcaccaagtacatgttgaactgtaactgctggctggccaaggacagaggcgacggcatcacctcccgtgtcttcgacctcttggatgccatggtggtgaacattggggtgaaggttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaagggatatttcctggctggcatctgagctatgtcgatgtgaaggacaactcccgcgacgagaccttccacttccagtgtgactgctggctctccaagagtgagggtgacgggcagacggtccgcgactttgcctgtgccaacaacaagatctgtgatgagctggaagagaccacctacgagatcgtcatagaaacgggcaacggaggcgaaaccagggagaacgtctggctcatcctggagggcaggaagaaccgatccaaagagtttctcatggaaaattcttctaggcagcgggcctttaggaaggggaccacagacacgtttgagtttgacagcatctacttgggggacattgcctccctctgtgtgggccaccttgccagggaagaccggtttatccccaagagagaacttgcctggcatgtcaagaccatcaccatcaccgagatggagtacggcaatgtgtacttctttaactgtgactgcctcatccccctcaagaggaagaggaagtacttcaaggtattcgaggttaccaagacgacagagagctttgccagcaaggtccagagcctggtgcccgtcaagtacgaagtcatcgtgacaacaggctatgagccaggggcaggcactgatgccaacgtcttcgtgaccatctttggggccaacggagacacaggcaagcgggagctgaagcagaaaatgcgcaacctcttcgagcggggcagcacagaccgcttcttcctggagacgctggagctggtagtgaccaggctgggacttgctgcagagtgtggatgagaaattgagtcttcacccaggggatagaagtggagaagcagaggccatcaagatggtgtattttaagcaaaaactaattaacacttttccccaaaaaagctaggctaattaaattattaccaaccatatcctataaagaactcatcttagcatctgcttgctaagaagtgtatacttttccccagtttcaataaacccagtggcaagtgga

SEQ ID NO: 16442 - DNA, 1958 bp, Homo sapiens
ctgcctcacagaggaagaaccgaggtgggggcttggtgaaggcacaccaggaagagcaggctgcgcctcaccctccagtggagacagagggcagacattctctttggagcacacctcaggctaaatggcaaaaccccaatctcaagtgaacatcatggaactaggggattgtctcacttctccagtggattgaggcagtgctccctctgttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaagggatatttcctggctggcatctgagctatgtcgatgtgaaggacaactcccgcgacgagaccttccacttccagtgtgactgctggctctccaagagtgagggtgacgggcagacggtccgcgactttgcctgtgccaacaacaagatctgtgatgagctggaagagaccacctacgagatcgtcatagaaacgggcaacggaggcgaaaccagggagaacgtctggctcatcctggagggcaggaagaaccgatccaaagagtttctcatggaaaattcttctaggcagcgggcctttaggaaggggaccacagacacgtttgagtttgacagcatctacttgggggacattgcctccctctgtgtgggccaccttgccagggaagaccggtttatccccaagagagaacttgcctggcatgtcaagaccatcaccatcaccgagatggagtacggcaatgtgtacttctttaactgtgactgcctcatccccctcaagaggaagaggaagtacttcaaggtattcgaggttaccaagacgacagagagctttgccagcaaggtccagagcctggtgcccgtcaagtacgaagtcatcgtgacaacaggctatgagccaggggcaggcactgatgccaacgtcttcgtgaccatctttggggccaacggagacacaggcaagcgggagctgaagcagaaaatgcgcaacctcttcgagcggggcagcacagaccgcttcttcctggagacgctggagctgggtgagctgcgcaaggtgcgcctggagcacgacagcagtggctactgctcaggctggctggtggagaaggtggaggtcaccaacaccagcaccggcgtggccaccatcttcaactgtggcaggtggctggacaagaagcggggggatggactcacctggagagacctcttcccttctgtctgaggggctagggcccccaccctctcactgagatgccccaatctcacatttctgccctccaccttggcggtcagcagcccttcaaagcctctagcattggcactgggggctagcagtccactgagaacttcatggggtcctgctccccaccctacccccagtttattgaacctacagtgataataattagcatgtgtcataa

SEQ ID NO: 16443 - DNA, 1824 bp, Homo sapiens
agaaccgaggtgggggcttggtgaaggcacaccaggaagagcaggctgcgcctcaccctccagtggagacagagggcagacattctctttggagcacacctcaggctaaatggcaaaaccccaatctcaagtgaacatcatggaactaggggattgtctcacttctccagtggattgaggcagtgctccctctgttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaagggatatttcctggctggcatctgagctatgtcgatgtgaaggacaactcccgcgacgagaccttccacttccagtgtgactgctggctctccaagagtgagggtgacgggcagacggtccgcgactttgcctgtgccaacaacaagatctgtgatgagctggaagagaccacctacgagatcgtcatagaaacgggcaacggaggcgaaaccagggagaacgtctggctcatcctggagggcaggaagaaccgatccaaagagtttctcatggaaaattcttctaggcagcgggcctttaggaaggggaccacagacacgtttgagtttgacagcatctacttgggggacattgcctccctctgtgtgggccaccttgccagggaagaccggtttatccccaagagagaacttgcctggcatgtcaagaccatcaccatcaccgagatggagtacggcaatgtgtacttctttaactgtgactgcctcatccccctcaagaggaagaggaagtacttcaaggtattcgaggttaccaagacgacagagagctttgccagcaaggtccagagcctggtgcccgtcaagtacgaagtcatcgtgacaacaggctatgagccaggggcaggcactgatgccaacgtcttcgtgaccatctttggggccaacggagacacaggcaagcgggagctgaagcagaaaatgcgcaacctcttcgagcggggcagcacagaccgcttcttcctggagacgctggagctgggtgagctgcgcaagtagtgaccaggctgggacttgctgcagagtgtggatgagaaattgagtcttcacccaggggatagaagtggagaagcagaggccatcaagatggtgtattttaagcaaaaactaattaacacttttccccaaaaaagctaggctaattaaattattaccaaccatatcctataaagaactcatcttagcatctgcttgctaagaagtgtatacttttccccagtttcaataaacccagtggcaagtgg

SEQ ID NO: 16444 - DNA, 1352 bp, Homo sapiens
agcatcgcgcgcaaggcctgccggttgctcggggtcgtatgacgcacttttccagctcgagccctcacgaggccgtgggtacgaccggaagccgcagttcagtgatggggagccgtgtttggcagtgcagaggtagcgaagtgtcccaagaacatggaagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcttgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcttatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtc

SEQ ID NO: 16445 - DNA, 1289 bp, Homo sapiens
agcatcgcgcgcaaggcctgccggttgctcggggtcgtatgacgcacttttccagctcgagccctcacgaggccgtgggtacgaccggaagccgcagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcttgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcttatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtc

SEQ ID NO: 16446 - DNA, 1424 bp, Homo sapiens
agcatcgcgcgcaaggcctgccggttgctcggggtcgtatgacgcacttttccagctcgagccctcacgaggccgtgggtacgaccggaagccgcagactgaatctcgctctgttgcccagcccatctcggcccactgaaacctccacctcccgggttcaagcgattctcctgcctcagcctcccgagtagctgagattacaggcgcctgccaccacgcccagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcttgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcttatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtcaaaaaaaaa

SEQ ID NO: 16447 - DNA, 1531 bp, Homo sapiens
agcatcgcgcgcaaggcctgccggttgctcggggtcgtatgacgcacttttccagctcgagccctcacgaggccgtgggtacgaccggaagccgcagactgaatctcgctctgttgcccagcccatctcggcccactgaaacctccacctcccgggttcaagcgattctcctgcctcagcctcccgagtagctgagattacaggcgcctgccaccacgcccaggcggtgtccctgaagtataaatccaaagccttcatgcctgtaatccgagtgctttaggaggccaaggcaggaggactgcttgagcccaggagtttgagaccagcctggacaacaaacatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcttgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcttatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtc

SEQ ID NO: 16448 - DNA, 1543 bp, Homo sapiens
agcatcgcgcgcaaggcctgccggttgctcggggtcgtatgacgcacttttccagctcgagccctcacgaggccgtgggtacgaccggaagccgcagactgaatctcgctctgttgcccagcccatctcggcccactgaaacctccacctcccgggttcaagcgattctcctgcctcagcctcccgagtagctgagattacaggcgcctgccaccacgcccagagagatatttttagcactattaaaatacatgcattggctcaatacatgaattggatcaattctggaaccctaacaagatcacatttttgaccaaagtcaatatcttggactatagttaatttatcaagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcttgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcttatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtc

SEQ ID NO: 16449 - DNA, 803 bp, Homo sapiens
aaaccgggatgttgcgggccgtagcgcgtgggcggccgtggggtcttgggcgcgcgcggtgtttctggcggtgggtcaggacttgcgggtcgcctccgccggtgttgaagcctcttgtgtgcacactttctcctcagcacttgggacgacctaatttcactgttaggaacggttgatcccgaacacaggagggagggtaaatatcgtaaaacatgttggacgctagctgtgtgcacgccccctgggagccaaaagggcgaagtaaaacatgcacacgaccgtaatgagattctgattcagtgatggggagccgtgtttggcagtgcagaggtagcgaagtgtcccaagaacatggaagactgaatctcgctctgttgcccagcccatctcggcccactgaaacctccacctcccgggttcaagcgattctcctgcctcagcctcccgagtagctgagattacaggcgcctgccaccacgcccagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtc

SEQ ID NO: 16450 - DNA, 885 bp, Homo sapiens
ggggtcgtatgacgcacttttccagctcgagccctcacgaggccgtgggtacgaccggaagccgcagttcagtgatggggagccgtgtttggcagtgcagaggtagcgaagtgtcccaagaacatggaagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcttgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcttatcatcaaattgataatcacattcacctaataaacccaacgg

SEQ ID NO: 16451 - DNA, 583 bp, Homo sapiens
gatgttgcgggccgtagcgcgtgggcggccgtggggtcttgggcgcgcgcggtgtttctggcggtgggtcaggacttgcgggtcgcctccgccggtgttgaagcctcttgtgtgcacactttctcctcagcacttgggacgacctaatttcactgttaggaacggttgatcccgaacacaggagggagggtaaatatcgtaaaacatgttggacgctagctgtgtgcacgccccctgggagccaaaagggcgaagtaaaacatgcacacgaccgtaatgagattctgagtaagttgtatatcattagagaggggacaaaataatagggtcttggcgaggtcttatgaagaagctgcgcctgcctagaaagatagatgggattgtgctgttttcgctttcagttcagtgatggggagccgtgtttggcagtgcagaggtagcgaagtgtcccaagaacatggaagcatgctgatcccattttcaatgaagaattgcttccagttactttgtaactgccaggtcccagcagctggctttaaaaaaacagtaaaaaatgggctcattttacagtcaatttccaatg

SEQ ID NO: 16452 - DNA, 482 bp, Homo sapiens
ggttgctcggggtcgtatgacgcacttttccagctcgagccctcacgaggccgtgggtacgaccggaagccgcagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagag

SEQ ID NO: 16453 - DNA, 7756 bp, Homo sapiens
agtggggcagcaaatggacagggtgggtggcggaaaagggcccgggggaagttattacagggtgtcctcttccgccgccagaagccggaagttgtgtcccggacgtgtcaaccggggtctgagtgctcagagtacagctgcaaccgcgaccatgggcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctctttagagtcctcggcagtaatatctgctttttttgaatgcttacgttttataatgcagcaaaacttaggtgaggaagagattgaacagatgctcgtcaatgatcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatgattacttgattggagacgtatatgttgaaagaatcattgttagacttcatgaaactttattcaaaacaaagaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccagattttcttatctgtaaactgaaaaatacttggctctctggtgtaaatttattggttcatcaaactgacagttcatataaagagagtaccttcctacatttgtctgctctgtggctgaagaaccaagttcaggcttcatctttggatatcaacagtctccaagtcctcttgtctgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaagaagaaaagaaagaatttagtgctcaatgtatacctgctcttttgggctggactaagaaagatctttgcagcactaatggaggttttggacatcttgccattttcaattcttgtctgcaaaccaaaagtatagatgatggagagctattacatggaatattaaaaatcataatatcctggaagaaagagcatgaagatatttttcttttcagttgtaatctatcagaagcaagtccagaggtactgggtgtaaatatagaaataatccggtttctttccctatttctgaaatactgctcatcccctttggcagagagtgagtgggacttcatcatgtgctccatgttggcttggttggagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaaattgatgcctgaattaccacagtatgatcaggataatctaaagtcatacggagatgaagaagaagagccagccttgtcaccaccagcagcactgatgtctcttcttagcattcaagaggacttactagaaaatgttttggggtgtattcctgttggacagatagttactattaaaccactgagtgaagacttctgttatgttctgggataccttctcacttggaaattaatactaactttcttcaaagctgcatcatcacagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagctccagctgagtattagagaaacaacaatgcttccataccacattccacacttggcttgttcagtctatcatatgacattaaaagacttgcctgccatggttaggttgtggtggaatagcagtgagaagcgtgttttcaatattgtggatagatttacaagcaagtatgtcagcagtgttctttcttttcaagaaatatcttctgtacaaacaagtacacaactatttaatggcatgacggttaaagctcgagctactactcgagaggtaatggctacttatactattgaggacatagttattgaacttataatacaactgccttcaaattatccactgggttcaataatagtagaaagtgggaaaagagtaggagtagctgttcagcagtggcggaactggatgctgcagttaagcacttacctcacccatcagaatggaagtattatggaaggcttagctttatggaaaaataacgtagacaaacgttttgagggtgttgaagattgcatgatctgtttctcagtcattcacggtttcaactattcccttcccaaaaaagcctgtagaacatgcaagaaaaaattccattcagcctgcttgtacaaatggtttacatctagcaacaaatccacttgtccactgtgtcgtgagacgtttttctgagatttttttcactggaagggatccctgaagtacatcaaacaaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccctaaattacagaattggaatttgtgaaaagattgcacaactatattattgataaacccattccgtttgttgatctgtgttttagaatagtccaagtgaagcaaaacgaactgagagagctgatttacatctatagatattttaagccttatttattagttatgacaataaattagtattctgatatttgtagattattttaatgataaaaatgacactaagctattaatacggcttgtcttaagatatctggaggcatgctctgaaatcctatataaaagagtttaaactgaactttaaggtgcctccatttatcaagggttatgaaactcagaaaattaaattcttgatgctgacctttttgcttgtgggagaattatttctatatattagtgaaatttgaattgtaaacttgtcagtgaatttatcactctgagcgagtctctagagggtgagaatttgagagaaatagtaatttgattatttcattcatgaagcggagtggtagttatccttctattgagagggaagaaataaatgagtattactgaaacttaaagatcagtggaaaaaaaaaacatttaaaaatgttgtaggagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaatagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactacctcgttaacccttttcttaaaatattctctatctttctatgtctctttctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttggtgaaacactataattaagtagttataattaaataactgttcttcatacttaggactcttaatacatttctttaagacttgtaagtataattgtaaagcttgttaactgtttatatactaaagaaaaagctttacaagataagactgaaattcagaataccacatctgtacagcgttgacaactctaactaaaaggattacagcccttaaaattttagcttaaggacattttaaaattgcatgagattagcaaaattattaatttaaaaccccaaagtaaattgcaaattttaaaatttatttttgactcttttatcacatgctccaatgtatgtacataagtgtctgtggcttaaataatatgttgttatttgatacatttttgtggtgcaagtaattaatgttattatttgattgttataccatatgtgcccattaaaattctttttaattaaaaatatttcaaatatgcagaaaaataataatataaatgcccttgtacccttcacatactattttgccatatttgcttctgatttttaaataaataaaatgttactcttttgtacttct

SEQ ID NO: 16454 - DNA, 7762 bp, Homo sapiens
agtggggcagcaaatggacagggtgggtggcggaaaagggcccgggggaagttattacagggtgtcctcttccgccgccagaagccggaagttgtgtcccggacgtgtcaaccggggtctgagtgctcagagtacagctgcaaccgcgaccatgggcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagcaaatgctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctctttagagtcctcggcagtaatatctgctttttttgaatgcttacgttttataatgcagcaaaacttaggtgaggaagagattgaacagatgctcgtcaatgatcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatgattacttgattggagacgtatatgttgaaagaatcattgttagacttcatgaaactttattcaaaacaaagaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccagattttcttatctgtaaactgaaaaatacttggctctctggtgtaaatttattggttcatcaaactgacagttcatataaagagagtaccttcctacatttgtctgctctgtggctgaagaaccaagttcaggcttcatctttggatatcaacagtctccaagtcctcttgtctgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaagaagaaaagaaagaatttagtgctcaatgtatacctgctcttttgggctggactaagaaagatctttgcagcactaatggaggttttggacatcttgccattttcaattcttgtctgcaaaccaaaagtatagatgatggagagctattacatggaatattaaaaatcataatatcctggaagaaagagcatgaagatatttttcttttcagttgtaatctatcagaagcaagtccagaggtactgggtgtaaatatagaaataatccggtttctttccctatttctgaaatactgctcatcccctttggcagagagtgagtgggacttcatcatgtgctccatgttggcttggttggagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaaattgatgcctgaattaccacagtatgatcaggataatctaaagtcatacggagatgaagaagaagagccagccttgtcaccaccagcagcactgatgtctcttcttagcattcaagaggacttactagaaaatgttttggggtgtattcctgttggacagatagttactattaaaccactgagtgaagacttctgttatgttctgggataccttctcacttggaaattaatactaactttcttcaaagctgcatcatcacagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagctccagctgagtattagagaaacaacaatgcttccataccacattccacacttggcttgttcagtctatcatatgacattaaaagacttgcctgccatggttaggttgtggtggaatagcagtgagaagcgtgttttcaatattgtggatagatttacaagcaagtatgtcagcagtgttctttcttttcaagaaatatcttctgtacaaacaagtacacaactatttaatggcatgacggttaaagctcgagctactactcgagaggtaatggctacttatactattgaggacatagttattgaacttataatacaactgccttcaaattatccactgggttcaataatagtagaaagtgggaaaagagtaggagtagctgttcagcagtggcggaactggatgctgcagttaagcacttacctcacccatcagaatggaagtattatggaaggcttagctttatggaaaaataacgtagacaaacgttttgagggtgttgaagattgcatgatctgtttctcagtcattcacggtttcaactattcccttcccaaaaaagcctgtagaacatgcaagaaaaaattccattcagcctgcttgtacaaatggtttacatctagcaacaaatccacttgtccactgtgtcgtgagacgtttttctgagatttttttcactggaagggatccctgaagtacatcaaacaaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccctaaattacagaattggaatttgtgaaaagattgcacaactatattattgataaacccattccgtttgttgatctgtgttttagaatagtccaagtgaagcaaaacgaactgagagagctgatttacatctatagatattttaagccttatttattagttatgacaataaattagtattctgatatttgtagattattttaatgataaaaatgacactaagctattaatacggcttgtcttaagatatctggaggcatgctctgaaatcctatataaaagagtttaaactgaactttaaggtgcctccatttatcaagggttatgaaactcagaaaattaaattcttgatgctgacctttttgcttgtgggagaattatttctatatattagtgaaatttgaattgtaaacttgtcagtgaatttatcactctgagcgagtctctagagggtgagaatttgagagaaatagtaatttgattatttcattcatgaagcggagtggtagttatccttctattgagagggaagaaataaatgagtattactgaaacttaaagatcagtggaaaaaaaaaacatttaaaaatgttgtaggagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaatagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactacctcgttaacccttttcttaaaatattctctatctttctatgtctctttctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttggtgaaacactataattaagtagttataattaaataactgttcttcatacttaggactcttaatacatttctttaagacttgtaagtataattgtaaagcttgttaactgtttatatactaaagaaaaagctttacaagataagactgaaattcagaataccacatctgtacagcgttgacaactctaactaaaaggattacagcccttaaaattttagcttaaggacattttaaaattgcatgagattagcaaaattattaatttaaaaccccaaagtaaattgcaaattttaaaatttatttttgactcttttatcacatgctccaatgtatgtacataagtgtctgtggcttaaataatatgttgttatttgatacatttttgtggtgcaagtaattaatgttattatttgattgttataccatatgtgcccattaaaattctttttaattaaaaatatttcaaatatgcagaaaaataataatataaatgcccttgtacccttcacatactattttgccatatttgcttctgatttttaaataaataaaatgttactcttttgtacttct

SEQ ID NO: 16455 - DNA, 7749 bp, Homo sapiens
cagcaaatggacagggtgggtggcggaaaagggcccgggggaagttattacagggtgtcctcttccgccgccagaagccggaagttgtgtcccggacgtgtcaaccggggtctgagtgctcagagtacagctgcaaccgcgaccatgggcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctctttagagtcctcggcagtaatatctgctttttttgaatgcttacgttttataatgcagcaaaacttaggtgaggaagagattgaacagatgctcgtcaatgatcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatgattacttgattggagacgtatatgttgaaagaatcattgttagacttcatgaaactttattcaaaacaaagaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccagattttcttatctgtaaactgaaaaatacttggctctctggtgtaaatttattggttcatcaaactgacagttcatataaagagagtaccttcctacatttgtctgctctgtggctgaagaaccaagttcaggcttcatctttggatatcaacagtctccaagtcctcttgtctgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaagaagaaaagaaagaatttagtgctcaatgtatacctgctcttttgggctggactaagaaagatctttgcagcactaatggaggttttggacatcttgccattttcaattcttgtctgcaaaccaaaagtatagatgatggagagctattacatggaatattaaaaatcataatatcctggaagaaagagcatgaagatatttttcttttcagttgtaatctatcagaagcaagtccagaggtactgggtgtaaatatagaaataatccggtttctttccctatttctgaaatactgctcatcccctttggcagagagtgagtgggacttcatcatgtgctccatgttggcttggttggagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaaattgatgcctgaattaccacagtatgatcaggataatctaaagtcatacggagatgaagaagaagagccagccttgtcaccaccagcagcactgatgtctcttcttagcattcaagaggacttactagaaaatgttttggggtgtattcctgttggacagatagttactattaaaccactgagtgaagacttctgttatgttctgggataccttctcacttggaaattaatactaactttcttcaaagctgcatcatcacagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagctccagctgagtattagagaaacaacaatgcttccataccacattccacacttggcttgttcagtctatcatatgacattaaaagacttgcctgccatggttaggttgtggtggaatagcagtgagaagcgtgttttcaatattgtggatagatttacaagcaagtatgtcagcagtgttctttcttttcaagaaatatcttctgtacaaacaagtacacaactatttaatggcatgacggttaaagctcgagctactactcgagaggtaatggctacttatactattgaggacatagttattgaacttataatacaactgccttcaaattatccactgggttcaataatagtagaaagtgggaaaagagtaggagtagctgttcagcagtggcggaactggatgctgcagttaagcacttacctcacccatcagaatggaagtattatggaaggcttagctttatggaaaaataacgtagacaaacgttttgagggtgttgaagattgcatgatctgtttctcagtcattcacggtttcaactattcccttcccaaaaaagcctgtagaacatgcaagaaaaaattccattcagcctgcttgtacaaatggtttacatctagcaacaaatccacttgtccactgtgtcgtgagacgtttttctgagatttttttcactggaagggatccctgaagtacatcaaacaaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccctaaattacagaattggaatttgtgaaaagattgcacaactatattattgataaacccattccgtttgttgatctgtgttttagaatagtccaagtgaagcaaaacgaactgagagagctgatttacatctatagatattttaagccttatttattagttatgacaataaattagtattctgatatttgtagattattttaatgataaaaatgacactaagctattaatacggcttgtcttaagatatctggaggcatgctctgaaatcctatataaaagagtttaaactgaactttaaggtgcctccatttatcaagggttatgaaactcagaaaattaaattcttgatgctgacctttttgcttgtgggagaattatttctatatattagtgaaatttgaattgtaaacttgtcagtgaatttatcactctgagcgagtctctagagggtgagaatttgagagaaatagtaatttgattatttcattcatgaagcggagtggtagttatccttctattgagagggaagaaataaatgagtattactgaaacttaaagatcagtggaaaaaaaaaacatttaaaaatgttgtaggagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaatagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactacctcgttaacccttttcttaaaatattctctatctttctatgtctctttctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttggtgaaacactataattaagtagttataattaaataactgttcttcatacttaggactcttaatacatttctttaagacttgtaagtataattgtaaagcttgttaactgtttatatactaaagaaaaagctttacaagataagactgaaattcagaataccacatctgtacagcgttgacaactctaactaaaaggattacagcccttaaaattttagcttaaggacattttaaaattgcatgagattagcaaaattattaatttaaaaccccaaagtaaattgcaaattttaaaatttatttttgactcttttatcacatgctccaatgtatgtacataagtgtctgtggcttaaataatatgttgttatttgatacatttttgtggtgcaagtaattaatgttattatttgattgttataccatatgtgcccattaaaattctttttaattaaaaatatttcaaatatgcagaaaaataataatataaatgcccttgtacccttcacatactattttgccatatttgcttctgatttttaaataaataaaatgttactcttttgtacttct

SEQ ID NO: 16456 - DNA, 2099 bp, Homo sapiens
gtactgcattcatgaagtaggctttgaaaattatacatcttggacaagtttttaagggatagtgggctttccttacacaactaaaataacctttacttcacataaggtttcctgctagaaactttcaaacacatacaaaaatcagagaaaatacactgggtagtaacaaacatctctttttgttctatttcaggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatctgtatctgtgc

SEQ ID NO: 16457 - DNA, 2209 bp, Homo sapiens
actgcgtccgcacgcgccccgcccctgagcagtccttgctgccccgcccccgctcggctcgccgccaggggacgctagtgggtccagtctccttggcaaccacttgctcctccccctccgcccctttaacctttagggtgcgcgggtgcagtatatctcgcgctctctcccctttccccctcccctttccccaccccgggcgctcaggttggtctggaccggaagcgaagatggcgacttctggcgcggcctcggcggagctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatctgtatctgtgcctta

SEQ ID NO: 16458 - DNA, 1230 bp, Homo sapiens
cttctctcctcactcacccttcctggtgctttgggctctccttccttctcagacaagatgtcttatcagaaaaagcagcccacccctcagcccccagtggactgcgtgaagacctctggcggcggtggcggtggcggcggcagcggcggtggtggctgcggcttcttcggcggcggcggctcagggggcggtagcagcggttctggctgcggctactccggcggcggtggctactctggcggcggctgcggcgggggctcctccggcggcgggggcgggggcggcattggaggctgcggagggggctccggtgggagcgtcaagtactccggaggcggcggctcctccggcgggggctctggctgtttctccagcggtgggggcggctccggctgcttctcctccggtggcggcggctcctccgggggcggctccggctgcttctccagcggtgggggcggctcctccgggggcggctccggctgcttctcctccggcggcggcggcttctcgggccaggcggtccagtgccagagctacggaggcgtctctagcggcggctcctccgggggcggctccggctgcttctccagcggcgggggcggcggctctgtctgcggctactctggcggcggctctggctgcggcggaggctcctctggcggcagcggctccggctacgtctcctcgcagcaggtcactcagacctcgtgcgcgccccagccgagttacggaggggggtcgtccggcggcggcggcagcggcggaagcggctgcttctccagcggcgggggcggcgggagctccggctgcggcggcggctcctccgggattggcagcggctgcatcatcagtggcgggggctccgtctgcggaggtggttcctctggaggcggcggcggcggctcctccgtgggtggctccgggagtggcaagggcgtcccgatctgccaccagacccagcagaagcaggcgcctacctggccgtccaaatagatcccccagggtaccacggaggcgaaggagttggaggtgttttccaggggcaccgatgggcttagagctctcatgatgctacccgaggtttgcaaatccttcatgtcttaacctacctggaagaagccattgagctctccggctgcatctagttctgctgtttagcctctttggtttctgtacaactacctcccaaccccagtgcctcagtcaataaatttgcaaattcatgag

SEQ ID NO: 16459 - DNA, 1190 bp, Homo sapiens
ggctctccttccttctcagacaagatgtcttatcagaaaaagcagcccacccctcagcccccagtggactgcgtgaagacctctggcggcggtggcggtggcggcggcagcggcggtggtggctgcggcttcttcggcggcggcggctcagggggcggtagcagcggttctggctgcggctactccggcggcggtggctactctggcggcggctgcggcgggggctcctccggcggcgggggcgggggcggcattggaggctgcggagggggctccggtgggagcgtcaagtactccggaggcggcggctcctccggcgggggctctggctgtttctccagcggtgggggcggctccggctgcttctcctccggtggcggcggctcctccgggggcggctccggctgcttctccagcggtgggggcggctcctccgggggcggctccggctgcttctcctccggcggcggcggcttctcgggccaggcggtccagtgccagagctacggaggcgtctctagcggcggctcctccgggggcggctccggctgcttctccagcggcgggggcggcggctctgtctgcggctactctggcggcggctctggctgcggcggaggctcctctggcggcagcggctccggctacgtctcctcgcagcaggtcactcagacctcgtgcgcgccccagccgagttacggagggggggtccggcggcggcggcagcggcggaagcggctgcttctccagcggcgggggcggcgggagctccggctgcggcggcggctcctccgggattggcagcggctgcatcatcagtggcgggggctccgtctgcggaggtggttcctctggaggcggcggcggcggctcctccgtgggtggctccgggagtggcaagggcgtcccgatctgccaccagacccagcagaagcaggcgcctacctggccgtccaaatagatcccccagggtaccacggaggcgaaggagttggaggtgttttccaggggcaccgatgggcttagagctctcatgatgctacccgaggtttgcaaatccttcatgtcttaacctacctggaagaagccattgagctctccggctgcatctagttctgctgtttagcctctttggtttctgtacaactacctcccaaccccagtgcctcagtcaataaatttgcaaattc

SEQ ID NO: 16460 - DNA, 2940 bp, Homo sapiens
gcggcggagctggcgctgggaggggaggagcgcgcagcccgcgcgccgcagggccgggcggaaagtttttcctgacggagttttggctgcggcagcggcggcggcggccggagcgggccatggacgcgctcaagtcggcggggcgggcgctgatccggagccccagcttggccaagcagagctgggggggcggtggccggcaccgcaagctgcctgagaactggacagacacgcgggagacgctgctggaggggatgctgttcagcctcaagtacctgggcatgacgctagtggagcagcccaagggtgaggagctgtcggccgccgccatcaagaggatcgtggctacagctaaggccagtgggaagaagctgcagaaggtgactctgaaggtgtcgccacggggaattatcctgacagacaacctcaccaaccagctcattgagaacgtgtccatatacaggatctcctattgcacagcagacaagatgcacgacaaggtgtttgcatacatcgcccagagccagcacaaccagagcctcgagtgccacgccttcctctgcaccaagcggaagatggcacaggctgttaccctcaccgtagcccaggccttcaaagtcgcctttgagttttggcaggtgtccaaggaagagaaagagaagagggacaaagccagccaagagggaggggacgtcctgggggcccgccaagactgcaccccctccttgaagagcttggtcgccactgggaacctgctggacttagaggagacagctaaggccccgctgtccacggtcagcgccaacaccaccaacatggacgaggtgccgcggccacaagccttgagtggcagcagtgttgtctgggagctggatgatggcctggatgaagcgttttcgaggcttgcccagtctcggacaaaccctcaggtcctggacactggcctgacagcccaggacatgcattacgcccagtgcctctcgcctgtcgactgggacaagcctgacagcagcggcacagagcaggatgacctcttcagcttctgagggcccggggccagccggacacaagcggccctgacacgtgatggaccaaagccacctgctgcgggggagccagttctggggcccgcctgccacctctcccagccctcagcattgtcagcctgaagatcagagctgcagccagtcaggcaggggagagatttttcttttaagccctgctctttctctgagaaccaaaagatgccttgaatatttattcagtgacttctggcttatgctcagaagccagtctgcgtcaggcacgtctcctgctgcgtgacatgtgcagtgctgtaatcggctcccgcttgctctcctggagcaagctctgccctggctgtgggtatcaggactgtgaccaaagcatttctagtcccttctctctttctaaggacccaaatttccctgggggcatcctgcttcctgaaagctgttggatttcagtgatttttccccccaccccccagcacaggagagcacccacagccgcagaaggggaatgtgtcctcctgctctgcttcctcagggcccagcaggcgggggtttgagccctggaccccaggctcttagagactaaggggcagctcctgaccaaagacgatacagcttggcactttaaagcattaacagcaggtgtgaccctgagggctcctccatggtgctgcattgagtccagctttccttctgcccttcctccaggagaaggggcccaaggtccccgtggatggtctccacctgtgcttggaaccagtgtaactggctgctccctgctcccagggactgacacggggatcatctctgtgaccgccctccgtcgggcccctgcctgccttctcccctccacgcaaggctgtgctcttcctctggtttctgtgtgtccgtttgagtgtctgcgccccgcctccccatacttcctgggatgatgtgtgaaacctgacacctagatttatttggaaatattctatgaccactttacagatgaggaaacaggcctcaagcgtggaggggtagagtgaagagtagaacccaggtctgatgccaaagctgctttcttctctgcctcctcctcacgcaactcacacctccttttcttctagctttgttgtcctcccaggaaccaaaaaaccccagctattttctgaccaaaatgtgtttcataacaaaccatctggtgcctttccacacagaactggcaggagcctcgtgtcctgctagctgtctctcttgttgatttccgtgaaaatgcaagtgtttgaagtctgctcattccgagggtgaaacaaaatccaaccctgtcagaatcatgctgttctctttgctgacactgtgaccctgggtcgggacagaccagcagcaatctgtctttagaatcgctttccttcctccccttttgcccccgtggggctcccggcatcctgaaagccagcaaagcctccagcatcttttccatcctgaggtgcctcccagtggcctggcttgtcggagcaagtttcatcagccctagggaaaacacggccctcctgggaacctccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcgaggcctgacacaggccagccttggcacgaggggggccaggggttctgagaagcgctgccctgtgagagccacgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaa

SEQ ID NO: 16461 - DNA, 2171 bp, Homo sapiens
acacagcctgggggcatccgaatgcacgggagatgttttacactcagatgaaacaaactgtttagacctcggggaaaagagactgtgcttgaacaaaatgaaccaggagaaagcgccctcctgagacatgtctctgctttcatgtttgaattgcctgggattctgttctctaatttctgatccttataaactaaaactgcctaggaacattgagcatcctgactttgaaggagtctctgtggtgtttttgtgctaccatacatggggaataatgatgtgaggcagagggagagggaatgaatgggagagccaagagggaagagcgagccggggggaaaggagcgcgcagtgtttcctgctgcggttaggacctcacgccttgccagtacagagctcggtggcaagagccgctgggagctgctcccatcagttagaggatgtggagagggagcaccagaagaggacagcccgcagcctggctcgcagcctgagggacgctgtgggtgctcccagccgggcgagcacgctctgggagcggatctgcaggggagaagcacgcgagcctaacgtgagcgtcccgcctgtcgcgtgtcctgccttggtaagcgccctctccggtccttccacactgaaagcttccagcagagatcaagggaaggagtattgtgtgagacttgcagatttcctcctttctgtctggactggtttgatatttgcctgttgaaaagattactgaacgcagtgtgacaagatgagccgtctagctgcgttctgcttgcctgtgtgtgtgacacgtccaggtgtgaggccaaacctgagaagtgcagactgctcactgatagacgttgctgtaaacagtagtgccctgggtgtacagctggtctcaggatcggagaccccggacttattctctgctcggtgacacggccggcttcctgccgcagagctcctggtttctgttgatggcagttgataattggtagccacagtctgcggtcggagccacagcatttgagtctagcacctggggtgggccctgctgatacagtagagagagagtgaacgaggcagacagaaacacaccccccccccctccacgctcacacactctcccacaccccatgccagctataactgcagctctgagctgcctggagaggagattgccggaagctgaagggatgctttgaacgtgggggggctgcgtcacagttggactcccacttgcagaggacctgattatgtccagtgaccacctgaacaacagcacactgaaggaggctcagttcaaagacctgttcttaaaaaaagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagc

SEQ ID NO: 16462 - DNA, 14897 bp, Homo sapiens
cagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctgattgagcacctgtacggcctgactgtgtttgagaattatctctatgccaccaactcggacaatgccaatgcccagcagaagacgagtgtgatccgtgtgaaccgctttaacagcaccgagtaccaggttgtcacccgggtggacaagggtggtgccctccacatctaccaccagaggcgtcagccccgagtgaggagccatgcctgtgaaaacgaccagtatgggaagccgggtggctgctctgacatctgcctgctggccaacagccacaaggcgcggacctgccgctgccgttccggcttcagcctgggcagtgacgggaagtcatgcaagaagccggagcatgagctgttcctcgtgtatggcaagggccggccaggcatcatccggggcatggatatgggggccaaggtcccggatgagcacatgatccccattgaaaacctcatgaacccccgagccctggacttccacgctgagaccggcttcatctactttgccgacaccaccagctacctcattggccgccagaagattgatggcactgagcgggagaccatcctgaaggacggcatccacaatgtggagggtgtggccgtggactggatgggagacaatctgtactggacggacgatgggcccaaaaagacaatcagcgtggccaggctggagaaagctgctcagacccgcaagactttaatcgagggcaaaatgacacaccccagggctattgtggtggatccactcaatgggtggatgtactggacagactgggaggaggaccccaaggacagtcggcgtgggcggctggagagggcgtggatggatggctcacaccgagacatctttgtcacctccaagacagtgctttggcccaatgggctaagcctggacatcccggctgggcgcctctactgggtggatgccttctacgaccgcatcgagacgatactgctcaatggcacagaccggaagattgtgtatgaaggtcctgagctgaaccacgcctttggcctgtgtcaccatggcaactacctcttctggactgagtatcggagtggcagtgtctaccgcttggaacggggtgtaggaggcgcaccccccactgtgacccttctgcgcagtgagcggccccccatctttgagatccgaatgtatgatgcccagcagcagcaagttggcaccaacaaatgccgggtgaacaatggcggctgcagcagcctgtgcttggccacccctgggagccgccagtgcgcctgtgctgaggaccaggtgttggacgcagacggcgtcacttgcttggcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccatcagcacacctgcccctcggaccgattcaagtgcgagaacaaccggtgcatccccaaccgctggctctgcgacggggacaatgactgtgggaacagtgaagatgagtccaatgccacttgttcagcccgcacctgcccccccaaccagttctcctgtgccagtggccgctgcatccccatctcctggacgtgtgatctggatgacgactgtggggaccgctctgatgagtctgcttcgtgtgcctatcccacctgcttccccctgactcagtttacctgcaacaatggcagatgtatcaacatcaactggagatgcgacaatgacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccaggccacgaggccccctggtggctgccacactgatgagttccagtgccggctggatggactatgcatccccctgcggtggcgctgcgatggggacactgactgcatggactccagcgatgagaagagctgtgagggagtgacccacgtctgcgatcccagtgtcaagtttggctgcaaggactcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgacaagctgtgtgatggcaacgacgactgtggcgacggctcagatgagggcgagctctgcgaccagtgctctctgaataacggtggctgcagccacaactgctcagtggcacctggcgaaggcattgtgtgttcctgccctctgggcatggagctggggcccgacaaccacacctgccagatccagagctactgtgccaagcatctcaaatgcagccaaaagtgcgaccagaacaagttcagcgtgaagtgctcctgctacgagggctgggtcctggaacctgacggcgagagctgccgcagcctggaccccttcaagccgttcatcattttctccaaccgccatgaaatccggcgcatcgatcttcacaaaggagactacagcgtcctggtgcccggcctgcgcaacaccatcgccctggacttccacctcagccagagcgccctctactggaccgacgtggtggaggacaagatctaccgcgggaagctgctggacaacggagccctgactagtttcgaggtggtgattcagtatggcctggccacacccgagggcctggctgtagactggattgcaggcaacatctactgggtggagagtaacctggatcagatcgaggtggccaagctggatgggaccctccggaccaccctgctggccggtgacattgagcacccaagggcaatcgcactggatccccgggatgggatcctgttttggacagactgggatgccagcctgccccgcattgaggcagcctccatgagtggggctgggcgccgcaccgtgcaccgggagaccggctctgggggctggcccaacgggctcaccgtggactacctggagaagcgcatcctttggattgacgccaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatggctcccaatccctgtgaggccaatgggggccagggcccctgctcccacctgtgtctcatcaactacaaccggaccgtgtcctgcgcctgcccccacctcatgaagctccacaaggacaacaccacctgctatgagtttaagaagttcctgctgtacgcacgtcagatggagatccgaggtgtggacctggatgctccctactacaactacatcatctccttcacggtgcccgacatcgacaacgtcacagtgctagactacgatgcccgcgagcagcgtgtgtactggtctgacgtgcggacacaggccatcaagcgggccttcatcaacggcacaggcgtggagacagtcgtctctgcagacttgccaaatgcccacgggctggctgtggactgggtctcccgaaacctgttctggacaagctatgacaccaataagaagcagatcaatgtggcccggctggatggctccttcaagaacgcagtggtgcagggcctggagcagccccatggccttgtcgtccaccctctgcgtgggaagctctactggaccgatggtgacaacatcagcatggccaacatggatggcagcaatcgcaccctgctcttcagtggccagaagggccccgtgggcctggctattgacttccctgaaagcaaactctactggatcagctccgggaaccataccatcaaccgctgcaacctggatgggagtgggctggaggtcatcgatgccatgcggagccagctgggcaaggccaccgccctggccatcatgggggacaagctgtggtgggctgatcaggtgtcggaaaagatgggcacatgcagcaaggctgacggctcgggctccgtggtccttcggaacagcaccaccctggtgatgcacatgaaggtctatgacgagagcatccagctggaccataagggcaccaacccctgcagtgtcaacaacggtgactgctcccagctctgcctgcccacgtcagagacgacccgctcctgcatgtgcacagccggctatagcctccggagtggccagcaggcctgcgagggcgtaggttcctttctcctgtactctgtgcatgagggaatcaggggaattcccctggatcccaatgacaagtcagatgccctggtcccagtgtccgggacctcgctggctgtcggcatcgacttccacgctgaaaatgacaccatctactgggtggacatgggcctgagcacgatcagccgggccaagcgggaccagacgtggcgtgaagacgtggtgaccaatggcattggccgtgtggagggcattgcagtggactggatcgcaggcaacatctactggacagaccagggctttgatgtcatcgaggtcgcccggctcaatggctccttccgctacgtggtgatctcccagggtctagacaagccccgggccatcaccgtccacccggagaaagggtacttgttctggactgagtggggtcagtatccgcgtattgagcggtctcggctagatggcacggagcgtgtggtgctggtcaacgtcagcatcagctggcccaacggcatctcagtggactaccaggatgggaagctgtactggtgcgatgcacggacagacaagattgaacggatcgacctggagacaggtgagaaccgcgaggtggttctgtccagcaacaacatggacatgttttcagtgtctgtgtttgaggatttcatctactggagtgacaggactcatgccaacggctctatcaagcgcgggagcaaagacaatgccacagactccgtgcccctgcgaaccggcatcggcgtccagcttaaagacatcaaagtcttcaaccgggaccggcagaaaggcaccaacgtgtgcgcggtggccaatggcgggtgccagcagctgtgcctgtaccggggccgtgggcagcgggcctgcgcctgtgcccacgggatgctggctgaagacggagcatcgtgccgcgagtatgccggctacctgctctactcagagcgcaccattctcaagagtatccacctgtcggatgagcgcaacctcaatgcgcccgtgcagcccttcgaggaccctgagcacatgaagaacgtcatcgccctggcctttgactaccgggcaggcacctctccgggcacccccaatcgcatcttcttcagcgacatccactttgggaacatccaacagatcaacgacgatggctccaggaggatcaccattgtggaaaacgtgggctccgtggaaggcctggcctatcaccgtggctgggacactctctattggacaagctacacgacatccaccatcacgcgccacacagtggaccagacccgcccaggggccttcgagcgtgagaccgtcatcactatgtctggagatgaccacccacgggccttcgttttggacgagtgccagaacctcatgttctggaccaactggaatgagcagcatcccagcatcatgcgggcggcgctctcgggagccaatgtcctgacccttatcgagaaggacatccgtacccccaatggcctggccatcgaccaccgtgccgagaagctctacttctctgacgccaccctggacaagatcgagcggtgcgagtatgacggctcccaccgctatgtgatcctaaagtcagagcctgtccaccccttcgggctggccgtgtatggggagcacattttctggactgactgggtgcggcgggcagtgcagcgggccaacaagcacgtgggcagcaacatgaagctgctgcgcgtggacatcccccagcagcccatgggcatcatcgccgtggccaacgacaccaacagctgtgaactctctccatgccgaatcaacaacggtggctgccaggacctgtgtctgctcactcaccagggccatgtcaactgctcatgccgagggggccgaatcctccaggatgacctcacctgccgagcggtgaattcctcttgccgagcacaagatgagtttgagtgtgccaatggcgagtgcatcaacttcagcctgacctgcgacggcgtcccccactgcaaggacaagtccgatgagaagccatcctactgcaactcccgccgctgcaagaagactttccggcagtgcagcaatgggcgctgtgtgtccaacatgctgtggtgcaacggggccgacgactgtggggatggctctgacgagatcccttgcaacaagacagcctgtggtgtgggcgagttccgctgccgggacgggacctgcatcgggaactccagccgctgcaaccagtttgtggattgtgaggacgcctcagatgagatgaactgcagtgccaccgactgcagcagctacttccgcctgggcgtgaagggcgtgctcttccagccctgcgagcggacctcactctgctacgcacccagctgggtgtgtgatggcgccaatgactgtggggactacagtgatgagcgcgactgcccaggtgtgaaacgccccagatgccctctgaattacttcgcctgccctagtgggcgctgcatccccatgagctggacgtgtgacaaagaggatgactgtgaacatggcgaggacgagacccactgcaacaagttctgctcagaggcccagtttgagtgccagaaccatcgctgcatctccaagcagtggctgtgtgacggcagcgatgactgtggggatggctcagacgaggctgctcactgtgaaggcaagacgtgcggcccctcctccttctcctgccctggcacccacgtgtgcgtccccgagcgctggctctgtgacggtgacaaagactgtgctgatggtgcagacgagagcatcgcagctggttgcttgtacaacagcacttgtgacgaccgtgagttcatgtgccagaaccgccagtgcatccccaagcacttcgtgtgtgaccacgaccgtgactgtgcagatggctctgatgagtcccccgagtgtgagtacccgacctgcggccccagtgagttccgctgtgccaatgggcgctgtctgagctcccgccagtgggagtgtgatggcgagaatgactgccacgaccagagtgacgaggctcccaagaacccacactgcaccagccaagagcacaagtgcaatgcctcgtcacagttcctgtgcagcagtgggcgctgtgtggctgaggcactgctctgcaacggccaggatgactgtggcgacagctcggacgagcgtggctgccacatcaatgagtgtctcagccgcaagctcagtggctgcagccaggactgtgaggacctcaagatcggcttcaagtgccgctgtcgccctggcttccggctgaaggacgacggccggacgtgtgctgatgtggacgagtgcagcaccaccttcccctgcagccagcgctgcatcaacactcatggcagctataagtgtctgtgtgtggagggctatgcaccccgcggcggcgacccccacagctgcaaggctgtgactgacgaggaaccgtttctgatcttcgccaaccggtactacctgcgcaagctcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcaggtcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacgggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaa

SEQ ID NO: 16463 - DNA, 6886 bp, Homo sapiens
aaatgtggaagctgaagctgcaagtcaagggcccgtctgacaagtccggcagggccgggaaaggggttaaggcgagcaagtgggtgtggcccgtgcgttgattggcaggggtgggaccgggcttgtcacccgccccggctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaattttgcaaattagctgcgagcctgagccccgcctctgcccatctcagtctatgctcacctcatcccactcctccctgtggagccctttgcttggccctctacctcctgccctcttcctgttcatctcccaaccactgcactcttgatttttataccacacagaaggtaagaaaattctaggaaccctaaggatcaatcctctccattttcactcaaatgcctggggcccagctctgcaatgactgactccagggcctctttcctcactgccagcatagaagtcaggggagccagctgggccctgcggtcaggaaggttctcatttttggagcataccctgagcccagatcataggagcagctgtccctggtgggacacaggagtcatgactcctaccctccaccctccacacccaccaggcatttagcagtctgtcctatgcaagacagatgaattctcagccaggatacctcaaggcaggcaaaggtgagtggagggagaattcacaaacattcagggtgtgtggtgctggcatcaccatggccaaatccaagaggtcttcctggaagagggcccaaactggaaccaaaagaatgctgtcagcagttggaatagagctgtgaattctagacagggggagtgtccccagaacaagcaaacggaggagacaagagggcaagggttataggaaagaccctgggcctgagagcacaagcagcggccagagctgcagcgctggggtgggtgatggagggaatgattcgcaagcagtgttggaacccagcccctagtgagcaaagtgacagaagctgccccagagtttggaaggaagatcgaggcagaagatgtagaaggaagctgtgggggtgggagtgatgcctcaggaacaaaactgaggaattccctaacggacccagtccctggggaaagaggctcccctcaggctctccttgtctagccccacacctggcagagcctgtcacccagcctagccccacgcctggcagagcccatcacccagcctagccccacacctggtggagaggccctgttgattacaccctgtcagcctcctcaaacccagcactaattgcacaattttcctctcttctagtgagcaagagcctgaggaagtagcagagaggggtgtgggcccatgtgcagttctgggaccctggcaccttggctcagggaagacccgagctcctttcactgcagaccctctccagagactggggagagggctctggagaacctggttcttgcttactgttctccctttgggccctccttcccaaacgcaaacaatccaggatccactcagcgtcaggcccaatggaaatagtgaagcagtgattttccctcccctgcctctccatagcctggtcttttgccctctcctttgctcttctcttcccccatagccacctcaaatacctgcagcctgatatcttcatcccttcatccagaccttttctctcctagtggtattgcaaactgaaagtggacaaagacttaaggtaaacctgctcctcatggtggaatgcttccaaatgctggaaggaggactttagggcagagttcactaaggaggcttgtgcttatagatcagtgggcctgaaagaagtttctctaggttctggttgtgtgctgtacgaggtgtaggtagtaataatactcttgtcagccacagtgaagccccaagctagccgggataggggactgaccttgtacaggcagcatggagaaactaagacagagtgtcctgcccaagtgatggcactggggagcagtcactcaggtttatttccaccagggcccaagaaaaaaagaaatgaggcaacctaaaattccatcaagatagataccaatatccaaggtgcttggtcttagcggtgtgggacccacgttaaggctcttggtgggaaggtgggaggtgttttcagcatgagatagggttcaggctgtgaatcagagtctagagcctaagataaaagaagataccagggctgggccacggtggctttcgcctgtaatcctagcactttgggaggccaaggcaggcagactgcctgagctcaggagttcgagactagcctgagcaacacggtgaaaccctgtctctactaaaatacaaaaaagtagccaggtgtggcggcatgcacctgtagtcccagctactcgagaggctgaggcaggagaattgcttgaacccgggaggcggaggttgcagtgagtggagatcgcgccactgcactctagcctgggtgacagagcgagactccttctccaaaaaaaaagaaaagaagataccagaactcagtccttaagaaacaaaattctgccaggcgcagtagctcacacctgtaatcccagcactttggaggggccaaggcaggcggatcgcttgaggccaagagttcaagaacagcctgggcaacatgatgaaaccctgtctctaccaaaaatactaaaaattagccagtctcacaacctggtctcaaaataaataaatagatttaaaaaaaaaatcatgggcctgaaccaagctccagacctcactaggaggggagaaggaccccccagccacacagcccaaggctgcagaagcacctaggtggttagagagtgagtgcctggatggggcgcagtggctcacacctgtaatcccagcactttgggaggccgaggcaggcggatcacgaggtcaagagatcaagaccatcctggccaacatggtgacaccgtgtctctactaaaaatacaaaaataagctgggcatggtggtgcgtgcctgtagtcccatctactcgggaggctgaagcaggagaatcacttgaacctgggaggcaaaggttgcagtgagctgagatcgcgccactgcactccagcctggcaacagagcgagacaagactccatctcaaaaaaaaaagtgagtgcccgatgatgccagattcttcatcacctgaagtgaacccacacaacagggctgggccatgggcatcataaaccccattttgcaagctcaggaggagctttagggaaatcagaagactggcccagtctctaccaagtggtggatttagagccggcatggcttcgttccaaatctcacccttgtcccaccattccatgggacctcccattcctgagggagcctggatacgggcaagtgcacaacccgggaggttgaggttacagtgagccatgatcgcaccactgcagtccagcccgagcaatagggtgagaccctccctctgaaaaaaataaaaatactcattttggaaggaagtcattctaaaatgttacacttgtcttcagcatatctgcaatataataattttctgcataactgaggatcattcacagaaaccaatggcttttctccagcagtgtcttctgaagttgtaacagtaggggcacggggagctatttgcttttatgctaaatgaccttagaccacttataaaatgcatatgagtgctttaaatgtta

SEQ ID NO: 16464 - DNA, 1780 bp, Homo sapiens
atgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctgtgagcaagagcctgaggaagtagcagagaggggtgtgggcccatgtgcagttctgggaccctggcaccttggctcagggaagacccgagctcctttcactgcagaccctctc

SEQ ID NO: 16465 - DNA, 15808 bp, Homo sapiens
aaagtgcagggggcgggccgggcggcagggggcctgcccgctggattcccgcatgcttgttccggggcggtcgggtctaaagggctttatgcactgtctggagggtggggactggcgcgggtagaaaacgggatgcctcgggcgtgggggcaggcttttggccactaggagctggcggaggtgcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagcgccggccagtggccaagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccaactcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgacgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttggttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgtcctcagccacagaacagataatgatggtttgggtttccgttgcaagtgcacattcggcttccaactggatacagatgagcgccactgcattgctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacagagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcaggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcaatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaatatgagaggttctttccggtgctcgtgtgatacaggctacatgttagaaagtgatgggaggacttgcaaagttacagcatctgagagtctgctgttacttgtggcaagtcagaacaaaattattgccgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaatgagcatctactgttctggtctgactggggccaccaccctcgcatcgagcgagccagcatggacggcagcatgcgcactgtcattgtccaggacaagatcttctggccctgcggcttaactattgactaccccaacagactgctctacttcatggactcctatcttgattacatggacttttgtgattataatggacaccatcggagacaggtgatagccagtgatttgattatacggcacccctatgccctaactctctttgaagactctgtgtactggactgaccgtgctactcgtcgggttatgcgagccaacaagtggcatggagggaaccagtcagttgtaatgtataatattcaatggccccttgggattgttgcggttcatccttcgaaacaaccaaattccgtgaatccatgtgccttttcccgctgcagccatctctgcctgctttcctcacaggggcctcatttttactcctgtgtttgtccttcaggatggagtctgtctcctgatctcctgaattgcttgagagatgatcaacctttcttaataactgtaaggcaacatataatttttggaatctcccttaatcctgaggtgaagagcaatgatgctatggtccccatagcagggatacagaatggtttagatgttgaatttgatgatgctgagcaatacatctattgggttgaaaatccaggtgaaattcacagagtgaagacagatggcaccaacaggacagtatttgcttctatatctatggtggggccttctatgaacctggccttagattggatttcaagaaacctttattctaccaatcctagaactcagtcaatcgaggttttgacactccacggagatatcagatacagaaaaacattgattgccaatgatgggacagctcttggagttggctttccaattggcataactgttgatcctgctcgtgggaagctgtactggtcagaccaaggaactgacagtggggttcctgccaagatcgccagtgctaacatggatggcacatctgtgaaaactctctttactgggaacctcgaacacctggagtgtgtcactcttgacatcgaagagcagaaactctactgggcagtcactggaagaggagtgattgaaagaggaaacgtggatggaacagatcgaatgatcctggtacaccagctttcccacccctggggaattgcagtccatgattctttcctttattatactgatgaacagtatgaggtcattgaaagagttgataaggccactggggccaacaaaatagtcttgagagataatgttccaaatctgaggggtcttcaagtttatcacagacgcaatgccgccgaatcctcaaatggctgtagcaacaacatgaatgcctgtcagcagatttgcctgcctgtaccaggaggattgttttcctgcgcctgtgccactggatttaaactcaatcctgataatcggtcctgctctccatataactctttcattgttgtttcaatgctgtctgcaatcagaggctttagcttggaattgtcagatcattcagaaaccatggtgccggtggcaggccaaggacgaaacgcactgcatgtggatgtggatgtgtcctctggctttatttattggtgtgattttagcagctcagtggcatctgataatgcgatccgtagaattaaaccagatggatcttctctgatgaacattgtgacacatggaataggagaaaatggagtccggggtattgcagtggattgggtagcaggaaatctttatttcaccaatgcctttgtttctgaaacactgatagaagttctgcggatcaatactacttaccgccgtgttcttcttaaagtcacagtggacatgcctaggcatattgttgtagatcccaagaacagatacctcttctgggctgactatgggcagagaccaaagattgagcgttctttccttgactgtaccaatcgaacagtgcttgtgtcagagggcattgtcacaccacggggcttggcagtggaccgaagtgatggctacgtttattgggttgatgattctttagatataattgcaaggattcgtatcaatggagagaactctgaagtgattcgttatggcagtcgttacccaactccttatggcatcactgtttttgaaaattctatcatatgggtagataggaatttgaaaaagatcttccaagccagcaaggaaccagagaacacagagccacccacagtgataagagacaatatcaactggctaagagatgtgaccatctttgacaagcaagtccagccccggtcaccagcagaggtcaacaacaacccttgcttggaaaacaatggtgggtgctctcatctctgctttgctctgcctggattgcacaccccaaaatgtgactgtgcctttgggaccctgcaaagtgatggcaagaattgtgccatttcaacagaaaatttcctcatctttgccttgtctaattccttgagaagcttacacttggaccctgaaaaccatagcccacctttccaaacaataaatgtggaaagaactgtcatgtctctagactatgacagtgtaagtgatagaatctacttcacacaaaatttagcctctggagttggacagatttcctatgccaccctgtcttcagggatccatactccaactgtcattgcttcaggtatagggactgctgatggcattgcctttgactggattactagaagaatttattacagtgactacctcaaccagatgattaattccatggctgaagatgggtctaaccgcactgtgatagcccgcgttccaaaaccaagagcaattgtgttagatccctgccaagggtacctgtactgggctgactgggatacacatgccaaaatcgagagagccacattgggaggaaacttccgcgtacccattgtgaacagcagtctggtcatgcccagtgggctgactctggactatgaagaggaccttctctactgggtggatgctagtctgcagaggattgaacgcagcactctgacgggcgtggatcgtgaagtcattgtcaatgcagccgttcatgcttttggcttgactctctatggccagtatatttactggactgacttgtacacacaaagaatttaccgagctaacaaatatgacgggtcaggtcagattgcaatgaccacaaatttgctctcccagcccaggggaatcaacactgttgtgaagaaccagaaacaacagtgtaacaatccttgtgaacagtttaatgggggctgcagccatatctgtgcaccaggtccaaatggtgccgagtgccagtgtccacatgagggcaactggtatttggccaacaacaggaagcactgcattgtggacaatggtgaacgatgtggtgcatcttccttcacctgctccaatgggcgctgcatctcggaagagtggaagtgtgataatgacaacgactgtggggatggcagtgatgagatggaaagtgtctgtgcacttcacacctgctcaccgacagccttcacctgtgccaatgggcgatgtgtccaatactcttaccgctgtgattactacaatgactgtggtgatggcagtgatgaggcagggtgcctgttcagggactgcaatgccaccacggagtttatgtgcaataacagaaggtgcatacctcgtgagtttatctgcaatggtgtagacaactgccatgataataacacttcagatgagaaaaattgccctgatcgcacttgccagtctggatacacaaaatgtcataattcaaatatttgtattcctcgcgtttatttgtgtgacggagacaatgactgtggagataacagtgatgaaaaccctacttattgcaccactcacacgtgcagcagcagtgagttccaatgcgcatctgggcgctgtattcctcaacattggtattgtgatcaagaaacagattgttttgatgcctctgatgaacctgcctcttgtggtcactctgagcgaacatgcctagctgatgagttcaagtgtgatggtgggaggtgcatcccaagcgaatggatctgtgacggtgataatgactgtggggatatgagtgacgaggataaaaggcaccagtgtcagaatcaaaactgctcggattccgagtttctctgtgtaaatgacagacctccggacaggaggtgcattccccagtcttgggtctgtgatggcgatgtggattgtactgacggctacgatgagaatcagaattgcaccaggagaacttgctctgaaaatgaattcacctgtggttacggactgtgtatcccaaagatattcaggtgtgaccggcacaatgactgtggtgactatagcgacgagaggggctgcttataccagacttgccaacagaatcagtttacctgtcagaacgggcgctgcattagtaaaaccttcgtctgtgatgaggataatgactgtggagacggatctgatgagctgatgcacctgtgccacaccccagaacccacgtgtccacctcacgagttcaagtgtgacaatgggcgctgcatcgagatgatgaaactctgcaaccacctagatgactgtttggacaacagcgatgagaaaggctgtggcattaatgaatgccatgacccttcaatcagtggctgcgatcacaactgcacagacaccttaaccagtttctattgttcctgtcgtcctggttacaagctcatgtctgacaagcggacttgtgttgatattgatgaatgcacagagatgccttttgtctgtagccagaagtgtgagaatgtaataggctcctacatctgtaagtgtgccccaggctacctccgagaaccagatggaaagacctgccggcaaaacagtaacatcgaaccctatctcatttttagcaaccgttactatttgagaaatttaactatagatggctatttttactccctcatcttggaaggactggacaatgttgtggcattagattttgaccgagtagagaagagattgtattggattgatacacagaggcaagtcattgagagaatgtttctgaataagacaaacaaggagacaatcataaaccacagactaccagctgcagaaagtctggctgtagactgggtttccagaaagctctactggttggatgcccgcctggatggcctctttgtctctgacctcaatggtggacaccgccgcatgctggcccagcactgtgtggatgccaacaacaccttctgctttgataatcccagaggacttgcccttcaccctcaatatgggtacctctactgggcagactggggtcaccgcgcatacattgggagagtaggcatggatggaaccaacaagtctgtgataatctccaccaagttagagtggcctaatggcatcaccattgattacaccaatgatctactctactgggcagatgcccacctgggttacatagagtactctgatttggagggccaccatcgacacacggtgtatgatggggcactgcctcaccctttcgctattaccatttttgaagacactatttattggacagattggaatacaaggacagtggaaaagggaaacaaatatgatggatcaaatagacagacactggtgaacacaacacacagaccatttgacatccatgtgtaccatccatataggcagcccattgtgagcaatccctgtggtaccaacaatggtggctgttctcatctctgcctcatcaagccaggaggaaaagggttcacttgcgagtgtccagatgacttccgcacccttcagctgagtggcagcacctactgcatgcccatgtgctccagcacccagttcctgtgcgctaacaatgaaaagtgcattcctatctggtggaaatgtgatggacagaaagactgctcagatggctctgatgaactggccctttgcccgcagcgcttctgccgactgggacagttccagtgcagtgacggcaactgcaccagcccgcagactttatgcaatgctcaccaaaattgccctgatgggtctgatgaagaccgtcttctttgtgagaatcaccactgtgactccaatgaatggcagtgcgccaacaaacgttgcatcccagaatcctggcagtgtgacacatttaacgactgtgaggataactcagatgaagacagttcccactgtgccagcaggacctgccggccgggccagtttcggtgtgctaatggccgctgcatcccgcaggcctggaagtgtgatgtggataatgattgtggagaccactcggatgagcccattgaagaatgcatgagctctgcccatctctgtgacaacttcacagaattcagctgcaaaacaaattaccgctgcatcccaaagtgggccgtgtgcaatggtgtagatgactgcagggacaacagtgatgagcaaggctgtgaggagaggacatgccatcctgtgggggatttccgctgtaaaaatcaccactgcatccctcttcgttggcagtgtgatgggcaaaatgactgtggagataactcagatgaggaaaactgtgctccccgggagtgcacagagagcgagtttcgatgtgtcaatcagcagtgcattccctcgcgatggatctgtgaccattacaacgactgtggggacaactcagatgaacgggactgtgagatgaggacctgccatcctgaatattttcagtgtacaagtggacattgtgtacacagtgaactgaaatgcgatggatccgctgactgtttggatgcgtctgatgaagctgattgtcccacacgctttcctgatggtgcatactgccaggctactatgttcgaatgcaaaaaccatgtttgtatcccgccatattggaaatgtgatggcgatgatgactgtggcgatggttcagatgaagaacttcacctgtgcttggatgttccctgtaattcaccaaaccgtttccggtgtgacaacaatcgctgcatttatagtcatgaggtgtgcaatggtgtggatgactgtggagatggaactgatgagacagaggagcactgtagaaaaccgacccctaaaccttgtacagaatatgaatataagtgtggcaatgggcattgcattccacatgacaatgtgtgtgatgatgccgatgactgtggtgactggtccgatgaactgggttgcaataaaggaaaagaaagaacatgtgctgaaaatatatgcgagcaaaattgtacccaattaaatgaaggaggatttatctgctcctgtacagctgggttcgaaaccaatgtttttgacagaacctcctgtctagatatcaatgaatgtgaacaatttgggacttgtccccagcactgcagaaataccaaaggaagttatgagtgtgtctgtgctgatggcttcacgtctatgagtgaccgccctggaaaacgatgtgcagctgagggtagctctcctttgttgctactgcctgacaatgtccgaattcgaaaatataatctctcatctgagaggttctcagagtatcttcaagatgaggaatatatccaagctgttgattatgattgggatcccaaggacataggcctcagtgttgtgtattacactgtgcgaggggagggctctaggtttggtgctatcaaacgtgcctacatccccaactttgaatccggccgcaataatcttgtgcaggaagttgacctgaaactgaaatacgtaatgcagccagatggaatagcagtggactgggttggaaggcatatttactggtcagatgtcaagaataaacgcattgaggtggctaaacttgatggaaggtacagaaagtggctgatttccactgacctggaccaaccagctgctattgctgtgaatcccaaactagggcttatgttctggactgactggggaaaggaacctaaaatcgagtctgcctggatgaatggagaggaccgcaacatcctggttttcgaggaccttggttggccaactggcctttctatcgattatttgaacaatgaccgaatctactggagtgacttcaaggaggacgttattgaaaccataaaatatgatgggactgataggagagtcattgcaaaggaagcaatgaacccttacagcctggacatctttgaagaccagttatactggatatctaaggaaaagggagaagtatggaaacaaaataaatttgggcaaggaaagaaagagaaaacgctggtagtgaacccttggctcactcaagttcgaatctttcatcaactcagatacaataagtcagtgcccaacctttgcaaacagatctgcagccacctctgccttctgagacctggaggatacagctgtgcctgtccccaaggctccagctttatagaggggagcaccactgagtgtgatgcagccatcgaactgcctatcaacctgccccccccatgcaggtgcatgcacggaggaaattgctattttgatgagactgacctccccaaatgcaagtgtcctagcggctacaccggaaaatattgtgaaatggcgttttcaaaaggcatctctccaggaacaaccgcagtagctgtgctgttgacaatcctcttgatcgtcgtaattggagctctggcaattgcaggattcttccactatagaaggaccggctcccttttgcctgctctgcccaagctgccaagcttaagcagtctcgtcaagccctctgaaaatgggaatggggtgaccttcagatcaggggcagatcttaacatggatattggagtgtctggttttggacctgagactgctattgacaggtcaatggcaatgagtgaagactttgtcatggaaatggggaagcagcccataatatttgaaaacccaatgtactcagccagagacagtgctgtcaaagtggttcagccaatccaggtgactgtatctgaaaatgtggataataagaattatggaagtcccataaacccttctgagatagttccagagacaaacccaacttcaccagctgctgatggaactcaggtgacaaaatggaatctcttcaaacgaaaatctaaacaaactaccaactttgaaaatccaatctatgcacagatggagaacgagcaaaaggaaagtgttgctgcgacaccacctccatcaccttcgctccctgctaagcctaagcctccttcgagaagagacccaactccaacctattctgcaacagaagacacttttaaagacaccgcaaatcttgttaaagaagactctgaagtatagctataccagctatttagggaataattagaaacacacttttgcacatatattttttacaaacagatgaaaaaagttaacattcagtactttatgaaaaaaatatatttttccctgtttgcctatagttggaggtatcctgtgtgtctttttttacttatgccgtctcatatttttacaaataattatcacaatgtactatatgtatatctttgcactgaagttgtctgaaggtaatactataaatatattgtatatttgtaaattttggaaagattatcctgttactgaatttgctaataaagatgtctgctgatttggttggtgatcattatagtaaatgatccaacaagaaaaggaattgactggggacctttagccgtgtctaaagaagaggcaccactcatatttcctataaaattatctaggaaaggaatccaggccccgctcttgggtccatttttacacattagcacttaattaatgttcaatattacatgtcaatttgattaatggctatgttgataggggccactatgtgttgtatagacatctggacttgactgtagactcctcagataatacagaaggtaggaaaagcaattcagtttggcccttctgtgtgttggcattgtctaaccagaactctctgtttcatgtgtgttctctcactagctgccaagacaacatttttatttgtgatgtctatgaggaaatcccatatcattaagtgccagtgtcctgcattgagtttgtggttaattaaatgagctcttctgctgatggaccctggagcaatttctcccctcacctgacattcaaggtggtcacctgccctagtagttggagctcagtagctgaatttctgaaaccaaatctgtgtcttcataaaataaggtgcaaaaaaaaaaaataccagttaagtaaagcctcaactgggtttttgtttctatgaaaatatcattataatcactatttatttcctaagttgaacctgaatagaaagggaaaccattcttattaagctttttattaggccctgtggctaaatgtgtacatttatattagaatgtactgtacagtccagatcttttctttaattcttattggttttttttttttttttttttttagagatggagtcttgctatattgccaaggctgatcttgaagtcctgggctcaagtgatcctcccacctcagcctcctgagtggttggggttacgggcgtgagccactgtgcctggcttccagctctcctcttaaatagtgggtatagtctgcacaacaggaaccatggcaggaatatacactttcccatagcaaatagcatacctgactctctgtgctaatattgcacatttgttaaacaatgaatgaatggatggatggatggatggatgaatgaatgaaacatatactactgattattttattccagagttctcaaaatatttgttgctgatattttgagtgctgactgtaattactttgattagataaacaactggaaataatgctgctgaaaaagttctaataaatgtgtattttatcaga

SEQ ID NO: 16466 - DNA, 4007 bp, Homo sapiens
aggcttttggccactaggagctggcggaggtgcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagcgccggccagtggccaagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccaactcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgacgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttgggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgtcctcagccacagaacagataatgatggtttgggtttccgttgcaagtgcacattcggcttccaactggatacagatgagcgccactgcattggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacagagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcaggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcagtaagtttcctgaccacagtttactggccataaactcattctgaacagtagcctggtgtgcatcaccattgtcacagtcactgtgtagctttgtaggaaggatttcagttcctctatgagttcacatctgtgtagggggtaaccataattgaattcaaatacatcaccattggataattttctgattaaatcctttgtacttggttatgtgtttttacttctttttatgtctttgttt

SEQ ID NO: 16467 - DNA, 2913 bp, Homo sapiens
tttgcctgaagaaaggtgacttctaacaactgtctgtgattctcagaaagctctactggttggatgcccgcctggatggcctctttgtctctgacctcaatggtggacaccgccgcatgctggcccagcactgtgtggatgccaacaacaccttctgctttgataatcccagaggacttgcccttcaccctcaatatgggtacctctactgggcagactggggtcaccgcgcatacattgggagagtaggcatggatggaaccaacaagtctgtgataatctccaccaagttagagtggcctaatggcatcaccattgattacaccaatgatctactctactgggcagatgcccacctgggttacatagagtactctgatttggagggccaccatcgacacacggtgtatgatggggcactgcctcaccctttcgctattaccatttttgaagacactatttattggacagattggaatacaaggacagtggaaaagggaaacaaatatgatggatcaaatagacagacactggtgaacacaacacacagaccatttgacatccatgtgtaccatccatataggcagcccattgtgagcaatccctgtggtaccaacaatggtggctgttctcatctctgcctcatcaagccaggaggaaaagggttcacttgcgagtgtccagatgacttccgcacccttcagctgagtggcagcacctactgcatgcccatgtgctccagcacccagttcctgtgcgctaacaatgaaaagtgcattcctatctggtggaaatgtgatggacagaaagactgctcagatggctctgatgaactggccctttgcccgcagcgcttctgccgactgggacagttccagtgcagtgacggcaactgcaccagcccgcagactttatgcaatgctcaccaaaattgccctgatgggtctgatgaagaccgtcttctttgtgagaatcaccactgtgactccaatgaatggcagtgcgccaacaaacgttgcatcccagaatcctggcagtgtgacacatttaacgactgtgaggataactcagatgaagacagttcccactgtgccagcaggacctgccggccgggccagtttcggtgtgctaatggccgctgcatcccgcaggcctggaagtgtgatgtggataatgattgtggagaccactcggatgagcccattgaagaatgcatgagctctgcccatctctgtgacaacttcacagaattcagctgcaaaacaaattaccgctgcatcccaaagtgggccgtgtgcaatggtgtagatgactgcagggacaacagtgatgagcaaggctgtgaggagaggacatgccatcctgtgggggatttccgctgtaaaaatcaccactgcatccctcttcgttggcagtgtgatgggcaaaatgactgtggagataactcagatgaggaaaactgtgctccccgggagtgcacagagagcgagtttcgatgtgtcaatcagcagtgcattccctcgcgatggatctgtgaccattacaacgactgtggggacaactcagatgaacgggactgtgggatgcgtctgatgaagctgattgtcccacacgctttcctgatggtgcatactgccaggctactatgttcgaatgcaaaaaccatgtttgtatcccgccatattggaaatgtgatggcgatgatgactgtggcgatggttcagatgaagaacttcacctgtgcttggatgttccctgtaattcaccaaaccgtttccggtgtgacaacaatcgctgcatttatagtcatgaggtgtgcaatggtgtggatgactgtggagatggaactgatgagacagaggagcactgtagaaaaccgacccctaaaccttgtacagaatatgaatataagtgtggcaatgggcattgcattccacatgacaatgtgtgtgatgatgccgatgactgtggtgactggtccgatgaactgggttgcaataaaggaaaagaaagaacatgtgctgaaaatatatgcgagcaaaattgtacccaattaaatgaaggaggatttatctgctcctgtacagctgggttcgaaaccaatgtttttgacagaacctcctgtctagatatcaatgaatgtgaacaatttgggacttgtccccagcactgcagaaataccaaaggaagttatgagtgtgtctgtgctgatggcttcacgtctatgagtgaccgccctggaaaacgatgtgcagctgagggtagctctcctttgttgctactgcctgacaatgtccgaattcgaaaatataatctctcatctgagaggttctcagagtatcttcaagatgaggaatatatccaagctgttgattatgattgggatcccaaggacataggcctcagtgttgtgtattacactgtgcgaggggagggctctaggtttggtgctatcaaacgtgcctacatccccaactttgaatccggccgcaataatcttgtgcaggaagttgacctgaaactgaaatacgtaatgcagccagatggaatagcagtggactgggttggaaggcatatttactggtcagatgtcaagaataaacgcattgaggtggctaaacttgatggaaggtacagaaagtggctgatttccactgacctggaccaaccagctgctattgctgtgaatcccaaactagggcttatgttctggactgactggggaaaggaacctaaaatcgagtctgcctggatgaatggagaggaccgcaacatcctggttttcgaggaccttggttggccaactggcctttctatcgattatttgaacaatgaccgaatctactggagtgacttcaaggaggacgttattgaaaccataaaatatgatgggactgataggagagtcattgc

SEQ ID NO: 16468 - DNA, 3690 bp, Homo sapiens
gagccgcagccagagccagagccggagccgcagccggaaccggagccggagccgcggggcaggaggcggcgcccgcgggcggccgggcccggcatggagaagcgcgcggccgcggggctggagggcgcgccgggcgcccgggcgcagctggccgtcgtctgtctggtgaacatctttctcaccgggagactcagcagtgcggttcctgccttagcggcctgcagtgggaagctggagcagcacacggagcggcgtggggtcatctacagcccggcctggcccctcaactacccgccaggcaccaactgcagctggtacatccagggcgaccgtggtgacatgattaccatcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgagggaagctgggccaggcatcctgccaggcagatgagttccgctgtgacaacggcaagtgcctgcccggcccgtggcagtgcaacacggtggacgagtgtggagacggctctgatgagggcaactgctcggcgcccgcctccgagcctccaggcagcctgtgccccggggggaccttcccatgcagcggggcgcgctccacgcgctgcctgcctgtggagcggcgctgtgacggcttgcaggactgcggcgacggctcggatgaggcgggctgccccgacctggcgtgcggccggcggctgggcagcttctacggctcctttgcctccccagacctgttcggcgccgctcgcgggccctcagaccttcactgcacgtggctggtggacacacaggactcccggcgggtgctgctgcagctggaactgcggctgggctatgacgactacgtgcaggtatacgagggcctgggcgagcgcggggaccgcctgctgcagacgctgtcctaccgcagcaaccaccggcccgtgagcctggaggccgcccagggccgcctcactgtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggccgagacgagcagggctgccctgcctgcccgcccgaccagtacccctgcgagggtggcagtggtctgtgctacacgcctgccgaccgctgcaacaaccagaaaagctgtcccgacggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacagggccttcgagacccagatgacgcgcctggaggctgagttcgtgcggcgggaggcacccccatcctatggtcagctcatcgcccagggcctcattccacccgtggaggactttcctgtctacagtgcgtcccaggcctctgtgctgcagaatcttcgcacagccatgcggagacagatgcgtcggcacgcctcccgccgggggccctcccgccgccgcctcggccgcctctggaaccggctctttcaccggccgcgggcgccccgaggccagatcccactgctgaccgcagcacgcccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggtagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcatttctaccctgcctctgcgtcctttcttatggagaggccctccggggaccccagcggaggggctggcccctaagccagctggctgcactggtgggcgggagctgtgggactgaacggcgggggggagaagagtggagtggtgagcccgtctgcagggtcccattgtacacaagcaccctggggtctcacttctctccccccactccattctgggaacccatttccagagaagcaggggaccagagcctttttgcttcatctgccctgcagtggcaacagctgcccctagagctgggagttgtcatgaggatggggccgggccatggggacgctgggtctcatccgtggtgactattttgctcacgcctcaccctcttcctgtccagcaaggcctctggaggacctgggttgggtggctcctgccaaaccctcatgcccctggccaggcaggcgccctttgccctccctgaaggtccaatctcctgggcaccgtggaagggctggggtgtgtgcctgctgtacatgaagcccctggagttccctgcaggcctcaaagcccccaggacatgctgctctgtgctttctggggacagagaggccgaggcaccaacagcagtggccacgtctgttccatcctatctcagggcctcggtttccccacctgtaagccagggtgagactgtgggctctgaagtcctgaccttcactctgtggtgatttacgggaagaaagacaatcccagcctggagcccctgagctctcctgggtggccgagctcagactggcatcgaggggcctggggtaggggcggactgagctgctaccccatcctcgacatccctttagggcagggggactctgggtgccatggtagggagcgcctgtgtcaagcagcaaagccccctaatgtcaagagcctcctccagggcctgccacggcatcttcctggccagcaacatgtgtgcacccaccgaggtacgccccagccactcccatctgtgcccatcagggactccccatagcacgagcgaacagccagccctgtttatttataggccttttcaggaagagctagcagggcagtgctaagacaggaaacccagtccacattttagggcttccttaaacaggcttctgagagtcgtatcttttttcttttttttccagaaaaaaacaaaacaaaacttttttgccaaaacacctcctcaataaacaacatgtaaac

SEQ ID NO: 16469 - DNA, 2880 bp, Homo sapiens
gcgcgtcacgtggctggcgcagcgcggcctccaggctccgggcgcggcctggcccctcaactacccgccaggcaccaactgcagctggtacatccagggcgaccgtggtgacatgattaccatcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgaggtgatggaggctgcagggcaggcaggacaccacggagcacaccgtgcatgcccacaggctcccggcccacaggggcggcaccctccacagggccccggctccctgtgggatgtcccctgaccgccctgtcaatctcaggacagtggcaggactgggcatgcggatgccttggacctctcaaggtcactggccccacttcccagtcttggctagtcctgggaactcacccctaaccccaggctcaggtcagggacagagcccaccctggtgttggaggggtctctgctgccacagtgatggggaaccacctgcccgcttttggccccaggccccctggccgaagggaggctcttctgtctcctgactgtcccctgctacgtctccaccccacagggaagctgggccaggcatcctgccaggcagatgagttccgctgtgacaacggcaagtgcctgcccggcccgtggcagtgcaacacggtggacgagtgtggagacggctctgatgagggcaactgctcggcgcccgcctccgagcctccaggcagcctgtgccccggggggaccttcccatgcagcggggcgcgctccacgcgctgcctgcctgtggagcggcgctgtgacggcttgcaggactgcggcgacggctcggatgaggcgggctgccccgacctggcgtgcggccggcggctgggcagcttctacggctcctttgcctccccagacctgttcggcgccgctcgcgggccctcagaccttcactgcacgtggctggtggacacacaggactcccggcgggtgctgctgcagctggaactgcggctgggctatgacgactacgtgcaggtatacgagggcctgggcgagcgcggggaccgcctgctgcagacgctgtcctaccgcagcaaccaccggcccgtgagcctggaggccgcccagggccgcctcactgtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggccgagacgagcagggctgccctgcctgcccgcccgaccagtacccctgcgagggtggcagtggtctgtgctacacgcctgccgaccgctgcaacaaccagaaaagctgtcccgacggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacaggtgggcgctgtgcccgcagccaggggaccgggcttcttcatcacccaggcttgctgtccccgtagctgtgggtttgcaaacgggggcctggactagctacatggaggctgccctggtgcacactggggtccctatatcttggggtgtctgggtggagggtcgtcctggaatcctgttgttgttcctgctgcaggtcccgggcagcccagtcatgtcgccctccgcccactgcttctagggccttcgagacccagatgacgcgcctggaggctgagttcgtgcggcgggaggcacccccatcctatggtcagctcatcgcccagggcctcattccacccgtggaggactttcctgtctacagtgcgtcccaggcctctgtgctgcagaatcttcgcacagccatgcggagacagatgcgtcggcacgcctcccgccgggggccctcccgccgccgcctcggccgcctctggaaccggctctttcaccggccgcgggcgccccgaggccagatcccactgctgaccgcagcacgcccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggtagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcatttctaccctg

SEQ ID NO: 16470 - DNA, 8076 bp, Homo sapiens
gtggccggggctgcggcgcggggggcggggcggtcgggcccgggacaccccctcccggtcccctggcggggcagcgtcggctctggcagcactggaggcggcggcggcccgagggcgacttgcggggcgcgcaggccgccgtgcacccgggacgcttccccctcggggaccctccgcgggcttctccgccgcgccgtccggcgggagccggcgggaccccgggcgagcggcgcgggcggcaccatgaggcggcagtggggcgcgctgctgcttggcgccctgctctgcgcacacggcctggccagcagccccgagtgtgcttgtggtcggagccacttcacatgtgcagtgagtgctcttggagagtgtacctgcatccctgcccagtggcagtgtgatggagacaatgactgcggggaccacagcgatgaggatggatgtatactacctacctgttcccctcttgactttcactgtgacaatggcaagtgcatccgccgctcctgggtgtgtgacggggacaacgactgtgaggatgactcggatgagcaggactgtcccccccgggagtgtgaggaggacgagtttccctgccagaatggctactgcatccggagtctgtggcactgcgatggtgacaatgactgtggcgacaacagcgatgagcagtgtgacatgcgcaagtgctccgacaaggagttccgctgtagtgacggaagctgcattgctgagcattggtactgcgacggtgacaccgactgcaaagatggctccgatgaggagaactgtccctcagcagtgccagcgcccccctgcaacctggaggagttccagtgtgcctatggacgctgcatcctcgacatctaccactgcgatggcgacgatgactgtggagactggtcagacgagtctgactgctcctcccaccagccctgccgctctggggagttcatgtgtgacagtggcctgtgcatcaatgcaggctggcgctgcgatggtgacgcggactgtgatgaccagtctgatgagcgcaactgcaccacctccatgtgtacggcagaacagttccgctgtcactcaggccgctgtgtccgcctgtcctggcgctgtgatggggaggacgactgtgcagacaacagcgatgaagagaactgtgagaatacaggaagcccccaatgtgccttggaccagttcctgtgttggaatgggcgctgcattgggcagaggaagctgtgcaacggggtcaacgactgtggtgacaacagcgacgaaagcccacagcagaattgccggccccggacgggtgaggagaactgcaatgttaacaacggtggctgtgcccagaagtgccagatggtgcggggggcagtgcagtgtacctgccacacaggctaccggctcacagaggatgggcacacgtgccaagatgtgaatgaatgtgccgaggaggggtattgcagccagggctgcaccaacagcgaaggggctttccaatgctggtgtgaaacaggctatgaactacggcccgaccggcgcagctgcaaggctctggggccagagcctgtgctgctgttcgccaatcgcatcgacatccggcaggtgctgccacaccgctctgagtacacactgctgcttaacaacctggagaatgccattgcccttgatttccaccaccgccgcgagcttgtcttctggtcagatgtcaccctggaccggatcctccgtgccaacctcaacggcagcaacgtggaggaggttgtgtctactgggctggagagcccagggggcctggctgtggattgggtccatgacaaactctactggaccgactcaggcacctcgaggattgaggtggccaatctggatggggcccaccggaaagtgttgctgtggcagaacctggagaagccccgggccattgccttgcatcccatggagggtaccatttactggacagactggggcaacaccccccgtattgaggcctccagcatggatggctctggacgccgcatcattgccgatacccatctcttctggcccaatggcctcaccatcgactatgccgggcgccgtatgtactgggtggatgctaagcaccatgtcatcgagagggccaatctggatgggagtcaccgtaaggctgtcattagccagggcctcccgcatcccttcgccatcacagtgtttgaagacagcctgtactggacagactggcacaccaagagcatcaatagcgctaacaaatttacggggaagaaccaggaaatcattcgcaacaaactccacttccctatggacatccacaccttgcacccccagcgccaacctgcagggaaaaaccgctgtggggacaacaacggaggctgcacgcacctgtgtctgcccagtggccagaactacacctgtgcctgccccactggcttccgcaagatcagcagccacgcctgtgcccagagtcttgacaagttcctgctttttgcccgaaggatggacatccgtcgaatcagctttgacacagaggacctgtctgatgatgtcatcccactggctgacgtgcgcagtgctgtggcccttgactgggactcccgggatgaccacgtgtactggacagatgtcagcactgataccatcagcagggccaagtgggatggaacaggacaggaggtggtagtggataccagtttggagagcccagctggcctggccattgattgggtcaccaacaaactgtactggacagatgcaggtacagaccggattgaagtagccaacacagatggcagcatgagaacagtactcatctgggagaaccttgatcgtcctcgggacatcgtggtggaacccatgggcgggtacatgtattggactgactggggtgcgagccccaagattgaacgagctggcatggatgcctcaggccgccaagtcattatctcttctaatctgacctggcctaatgggttagctattgattatgggtcccagcgtctatactgggctgacgccggcatgaagacaattgaatttgctggactggatggcagtaagaggaaggtgctgattggaagccagctcccccacccatttgggctgaccctctatggagagcgcatctattggactgactggcagaccaagagcatacagagcgctgaccggctgacagggctggaccgggagactctgcaggagaacctggaaaacctaatggacatccatgtcttccaccgccgccggcccccagtgtctacaccatgtgctatggagaatggcggctgtagccacctgtgtcttaggtccccaaatccaagcggattcagctgtacctgccccacaggcatcaacctgctgtctgatggcaagacctgctcaccaggcatgaacagtttcctcatcttcgccaggaggatagacattcgcatggtctccctggacatcccttattttgctgatgtggtggtaccaatcaacattaccatgaagaacaccattgccattggagtagacccccaggaaggaaaggtgtactggtctgacagcacactgcacaggatcagtcgtgccaatctggatggctcacagcatgaggacatcatcaccacagggctacagaccacagatgggctcgcggttgatgccattggccggaaagtatactggacagacacgggaacaaaccggattgaagtgggcaacctggacgggtccatgcggaaagtgttggtgtggcagaaccttgacagtccccgggccatcgtactgtaccatgagatggggtttatgtactggacagactggggggagaatgccaagttagagcggtccggaatggatggctcagaccgcgcggtgctcatcaacaacaacctaggatggcccaatggactgactgtggacaaggccagctcccaactgctatgggccgatgcccacaccgagcgaattgaggctgctgacctgaatggtgccaatcggcatacattggtgtcaccggtgcagcacccatatggcctcaccctgctcgactcctatatctactggactgactggcagactcggagcatccaccgtgctgacaagggtactggcagcaatgtcatcctcgtgaggtccaacctgccaggcctcatggacatgcaggctgtggaccgggcacagccactaggttttaacaagtgcggctcgagaaatggcggctgctcccacctctgcttgcctcggccttctggcttctcctgtgcctgccccactggcatccagctgaagggagatgggaagacctgtgatccctctcctgagacctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaacttggatggttctgagcggaaggtcctcatcaacacagacctgggttggcccaatggccttaccctggactatgatacccgcaggatctactgggtggatgcgcatctggaccggatcgagagtgctgacctcaatgggaaactgcggcaggtcttggtcagccatgtgtcccacccctttgccctcacacagcaagacaggtggatctactggacagactggcagaccaagtcaatccagcgtgttgacaaatactcaggccggaacaaggagacagtgctggcaaatgtggaaggactcatggatatcatcgtggtttcccctcagcggcagacagggaccaatgcctgtggtgtgaacaatggtggctgcacccacctctgctttgccagagcctcggacttcgtatgtgcctgtcctgacgaacctgatagccggccctgctcccttgtgcctggcctggtaccaccagctcctagggctactggcatgagtgaaaagagcccagtgctacccaacacaccacctaccaccttgtattcttcaaccacccggacccgcacgtctctggaggaggtggaaggaagatgctctgaaagggatgccaggctgggcctctgtgcacgttccaatgacgctgttcctgctgctccaggggaaggacttcatatcagctacgccattggtggactcctcagtattctgctgattttggtggtgattgcagctttgatgctgtacagacacaaaaaatccaagttcactgatcctggaatggggaacctcacctacagcaacccctcctaccgaacatccacacaggaagtgaagattgaagcaatccccaaaccagccatgtacaaccagctgtgctataagaaagagggagggcctgaccataactacaccaaggagaagatcaagatcgtagagggaatctgcctcctgtctggggatgatgctgagtgggatgacctcaagcaactgcgaagctcacgggggggcctcctccgggatcatgtatgcatgaagacagacacggtgtccatccaggccagctctggctccctggatgacacagagacggagcagctgttacaggaagagcagtctgagtgtagcagcgtccatactgcagccactccagaaagacgaggctctctgccagacacgggctggaaacatgaacgcaagctctcctcagagagccaggtctaaatgcccacattctcttccctgcctgcctgttccttctcctttatggacgtctagtccttgtgctcgcttacaccgcaggccccgcttctgtgtgcttgtcctcctcctcctcccaccccataactgttcctaagccttcaccggagctgtttaccacgtgagtccataactacctgtgcacaagaaatgatggcacatcacgagaatttagacctggattttaccatgaacctcacatcttgtactccatcctgggccccctgaaactgcttattcgtgattcctcaccagcgtagagctccacctcccctttccccagtaccctcagtgcctgcttctcagtgctgatgcagctgatgacccaggactgcgctctgccccatcacagccagcatgactgcttctctgagagaacttgcccatcaggggctgggacatgggggtgtgggtaaagacagggatgaaggatagaggctgagagaagaaggaagaatcagcccagcaggtatgggcatctgggaaacctccagcctcaagtgtgttagtaacatgaaaaagctttggggggtagttggatctgggtgtctggtccattgctggcagtggacattattcttgccctaagagacactgccttttcagcagcagatactggtgagatgggggtggctcaggctgttcttcctcctcctagaatgtctggagctgtttctacattcagataactgggtcccctatcacaaggctactggctaataggaattccctcctggtgccaccactggccagtacctttcctaagtctttgctcaaattaaccaggttgtgagccagtggcttgagtgaatgttaggccttgggggctgagtctctgaaaagtctaagaagctctgcctagaccaaatatggtatacctcctgacccctctctccctcatgtcctgggattctggggaagagacctagaaacaagctttcaaagaaaaaccagaagttgtcataaatggtcagaaagaacgatcaggttggagacttgggaaacccagggcctaaagagaagtatccatgagggtcaaacttcctgttgaacttcctatgttctttctcaagtgctcagggatctaagttagtggacagcaagcctgtggctacggggtggtgatgttcctcttccagctgtcccctcagctaaggggcttagtttccatgtgggatgccatcacttggttcatgctcattcacacaaagggcacgtgtctcagcctggtatcagggaaattgagacttatttttgccctaaaacgtctccctagctgttcttcgtggggtttttttgtttgtttttttgcctaatttgctttttctgaccaagccttgtggcaccagcaatctccaaagtcctgtggtgggagggctgaataaataaaaatacaaagaggtgggtaaggagtaggaaggtagagagcaccactgatgaggccctcctagcccatggcagacccagacctcttctcccccaggaattagaagtggcaggagagaacaacaggggctgggaatggaggggagaatttctaggggaagtttcctgagttgaaacttctcctgtggttactggtattgagaaatcagctaccaaagtgaaaaaggacaagatcaattcttttctagtcagttctaagactgctagagagagataccaggcccttagccttgctctcagtagcgtcagccccagttctgagcctccccacattacacttaacaagcagtaaaggagtgagcactttgggtccttagactcacgtctggggaggaagagcaagtagaaaagtggcattttcttgattggaaagggggaaggatcttattgcacttgggctgttcagaatgtagaaaggacatatttgaggaagtatctatttgagcactgatttactctgtaaaaagcaaaatctctctgtcctaaactaatggaagcgattctcccatgctcatgtgtaatggttttaacgttactcactggagagattggactttctggagttatttaaccactatgttcagtattttaggactttatgataatttaatataaatttagcttttcttaatc

SEQ ID NO: 16471 - DNA, 5159 bp, Homo sapiens
gcccgaggggggaggcggaggcgccgggagccgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacatttttgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaa

SEQ ID NO: 16472 - DNA, 10020 bp, Homo sapiens
gcggccgccccggctcctcgcctcccccacttctggccacccctcgccggtgagagaagagaacgcgagaagggaagatgggggccgtcctgaggagcctcctggcctgcagcttctgtgtgctcctgagagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatgccacaaatccatgtggaattgacaatgggggttgttcccatttgtgtttgatgtctccagtcaagcctttttatcagtgtgcttgccccactggggtcaaactcctggagaatggaaaaacctgcaaagatggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaaggatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttgggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtgctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccagggctttactgtggttgtgagctcagttccgagtcagaacctggaaatacaaccctatgacctcagcattgatatttacagccgctacatctactggacttgtgaggctaccaatgtcattaatgtgacaagattagatgggagatcagttggagtggtgctgaaaggcgagcaggacagacctcgagccgttgtggtaaacccagagaaagggtatatgtattttaccaatcttcaggaaaggtctcctaaaattgaacgggctgctttggatgggacagaacgggaggtcctctttttcagtggcttaagtaaaccaattgctttagcccttgatagcaggctgggcaagctcttttgggctgattcagatctccggcgaattgaaagcagtgatctctcaggtgctaaccggatagtattagaagactccaatatcttgcagcctgtgggacttactgtgtttgaaaactggctctattggattgataaacagcagcaaatgattgaaaaaattgacatgacaggtcgagagggtagaaccaaagtccaagctcgaattgcccagcttagtgacattcatgcagtaaaggagctgaaccttcaagaatacagacagcacccttgtgctcaggataatggtggctgttcacatatttgtcttgtaaagggggatggtactacaaggtgttcttgccccatgcacctggttctacttcaagatgagctatcatgtggagaacctccaacatgttctcctcagcagtttacttgtttcacgggggaaattgactgtatccctgtggcttggcggtgcgatgggtttactgaatgtgaagaccacagtgatgaactcaattgtcctgtatgctcagagtcccagttccagtgtgccagtgggcagtgtattgatggtgccctccgatgcaatggagatgcaaactgccaggacaaatcagatgagaagaactgtgaagtgctttgtttaattgatcagttccgctgtgccaatggtcagtgcattggaaagcacaagaagtgtgatcataatgtggattgcagtgacaagtcagatgaactggattgttatccgactgaagaaccagcaccacaggccaccaatacagttggttctgttattggcgtaattgtcaccatttttgtgtctggaactgtatactttatctgccagaggatgttgtgtccacgtatgaagggagatggggaaactatgactaatgactatgtagttcatggaccagcttctgtgcctcttggttatgtgccacacccaagttctttgtcaggatctcttccaggaatgtctcgaggtaaatcaatgatcagctccctcagtatcatggggggaagcagtggacccccctatgaccgagcccatgttacaggagcatcatcaagtagttcttcaagcaccaaaggcacttacttccctgcaattttgaaccctccaccatccccagccacagagcgatcacattacactatggaatttggatattcttcaaacagtccttccactcataggtcatacagctacaggccatatagctaccggcactttgcaccccccaccacaccctgcagcacagatgtttgtgacagtgactatgctcctagtcggagaatgacctcagtggcaacagccaagggctataccagtgacttgaactatgattcagaacctgtgcccccacctcccacaccccgaagccaatacttgtcagcagaggagaactatgaaagctgcccaccttctccatacacagagaggagctattctcatcacctctacccaccgccaccctctccctgtacagactcctcctgaggaggggccctcctcctctgactgcctccaacgtaaaaatgtaaatataaatttggttgagatctggagggggggagggagctattagagaaggatgaggcagaccatgtacagttaaaattataaaatggggtagggaatactggagatatttgtacagaagaaaaggatatttatatattttcttaaaacagcagatttgctgcttgtgccataaaagtttgtataaaaaaaatttgtactaaaagttttatttttgcaaactaaatacacaaagcatgccttaaacccagtgaagcaactgagtacaaaggaaacaggaataataaaggcatcactgaccaggaatatctgggctttattgataccaaaaataaaaaagaggaagaagaaaaattaagtccatctcagagcagcaaaccatagatacatggatgtagccagatagccttcagttaactaacatttgagggccaacaagtaagaaatgatgaaaggaaaaaaatgcaattaatactaaccttggacgaagggctttgttttctctaggaatccaacagtgctagtgaggaaagtagatatttctaaaaacccattctgggtgttgctgttgtaggagagatcagccctctggtaagatgccatgaagctgtgtgtgtgtgcaagtctctgtccctacctttagaatccatacctctgtcaaaatgaatttttttctctaggtatgtttaccttgctgcctcctccagcaacttggtaagtcattttgctaagataccatgatttttttaagctgaagcattgactaaatggaattttctaaattaaacttgattttaatatttcttctagctccattccccagtaggcttagctcttcaatttgactgctgtttttgcataatgatcaaaagttagacatattatttctcttcttccaagattgttttaatgctcattaaaatgtctttttacaacacatatagacaatgtttaagaattaaaaatttaaccattatgtttttgttgtaaatctcatatccttgcactactttcagcatatatcacagtacgaaatcatttatatatatatatatatatatatatatatatatatatatatatatatatatattttgtttgtttgtttgttttctgagtaaaacatttaaatatgttctggttagagacaatctatttaaaaagatttttttcttattaggattttccctatattaacagtttgtgatgttttcatgttctttagaccggtttttctcagaataatgtctacatacatacctcttctaatgtgtgacatgaatttaatatctttctgttacccactgtgaatgttaggctgttttcaaattatccacaaattattcttgtaatcacccaatatttttatgtgggtcctctcttacccattatggattaagatagtttaacaaatttaacaatgaggattaaatgagaaggcaaactgttaacttctcagctgtcagaatttgggtggaagggaataatggaagcctcttttgtgatctgcctgacctgctgtcatgtatggtactggggctgctacatcttgagctatcagggctgacctgtggaatgattctagcacttgctctgccaccttgccagaagttcgtttcctgctttttacacatgtgtagcacttctctgctaaaattgaatggttttaaactaatgtatttttagcttaagaggtgttggtcagttaattattgaattttttttttttcttttttaattctgtcttgccaaggcctctctgggtttcagggcccaagagaaaacagtggaagaaaggattcagaatttgggcaagggtgaagtaactgttcatgcaagttaaaaatacctaagtaaagtttttgaagataaaattgtggtttcagaataatgctgattgttggagactgtaagaatcaggtgcacttgattttgcatataagcaaatggtaaatctatcagaatcctaaaacagacaagcatgaactcttcccattgctggaactaagtgcccacagtgtcagacaaaatggacattgaacttggattctgtgatacacagggcacttgatgcttaaatgaagatggaaaggttagcaatacctgggtgtcagttagaatttgagaattctatatgtttacatatttaaatgtgcatcttgatctggtgggcttcccatgtggagacttgcactctaattaactaagaagaatattgccttgttggatctcagtccacgtgcttgcactgcgatggcaatggcctcttcttcaaaatactaatttgtgtgccaatttgtttaaaattatttgaaggcagttcagcctaatctcagtgttctctttctggggtagatgagatggattcttaatatttctgggagtactttttaatgagagaattgtcaaatttggaaagatttattgagccttaggttacatggacagttaagcttaagtaaactgtatattgattatcaaacacaagctgtaattggaaaagttgagaggaaaagcatgagatcacaaattagggggaaaaaagaaaagggatttttaaatttggtgtattaaattcattgtccaagggggaaaatgaataatgtttcattagattccttatatgcaaaagtatttattttgaacatgtgtcctaaaatatatgcactaactgatgtgattaaaattgtccaagaaataaacttgagcataacatactttgtgtgcaccacagtaagctattctgcattgaagtggtcttttataactaaggcctggactttgctccaacagagtcgtggtcttctgaatagtgacttaaggagttttgtttgcttaagtcagataatagcacattcacagggaaacaaagagagttggtggatagaattttctgactattaatttttcttccatgaaattttattatgcctttggcactttctgccactcttacagcatatcacaagatatctgtttagcagaagattatgtagttactttaattttaatataaaagtagcttgtgatacattaccaagagatctctgattctttagtaagtttgagaacacctattctacagagatgataggtacttagaaatgaagactttaaagtacattttaatctaatataggccagtaattgggggaaggggctttgagcagtacaattttaagatgattttgagggttgtatttctttatcatttaaaaatatcctaaagtcagtaatttatatgaaggaaactcattcattattgaaggtattaaaaatagccatcatctgtattaggtagcagttttggaggatcatctttttcttttgctataaagccctattaatgaagaatacttccagtagagttaatagctgtagcttacctagtgtgttaatgaagtgtgtttatttatgtgacttgataccagtagtcataatagagactgaagaggtatgcgttaagcacgcctacttctatgcagtaaacaggctgcagctgcctagattagattcttagaaatgtcatattttgaattgttttatttcttgtaggggaagctttgtcccacttcattcatttgcatgccataggaattacatattggttatcattacgtatctaacaagattcagaaacaaaaatcttggacttttcacatccgaaatatgtcagctcttaataaatgtgtggtgcttaagtctacatatggcatccatagttgatttagagtatggatatgagtgtgttgaccagttatcagtaggtggacaaatatttgggcatctacagatgagactatgcactaagtgtggactgagtcctaaagaagcttatagtcaggtgttgtttaaaacattatcagaattcttaaacccaaggaatttaattttatttggtatttcttaagcctaaaatgaaccaagagaaagatgattttagaaagtacttgtagtgaaagatgattttagaaagtacttgtagtgcatgtgtggcttctgacttttgggatggcaccattttataatagtttcaaaatttagcttttgaaattctcaacattttatggtagaagactttggacctcaagtataaaattatacgtttataatttttttaaaatttaaattataagtattgtgaattcacactctcaggctattgtctgacttgatctacgtctcataaagcctgtacctgagtggagtggaaggtggagtcttaggttaatcagttactgactctaccctcaccctctttcaattgaggtaaactttgctgtttttctttttcataaagcattctcaaattgttgagtttattgctgaaaaaaatctccatgactttacagatagaattacaaactaaatgatgtcttgtatttagaagcagagtacagacctaacgaactgttagattctccaccatcacttagggtttgcccagaagcaacaccagagaattacagacaacgcgcttttgctgaactgtccattttggtggttgtgtttttcagtcaaatataagcaggatgggcgatagagatatatttatatatagatacatattctatatatctaatgcctaaatatgggtattaaagggaaaatttttaaagtctgattaaatccaatatgacatgaaattaaatatatggattagtaaggaaaaatgttaaaaagtagagaggataccaagaagattaaactggactagccttatttgcaagtgaaggatctggtgctgctttcagatgtttatcttttatttttttcccttaagctttaatcttcgtcattgtcttaaagtcaactggtgtttcttgttcattgactttggtacgatggtgctttgcaaggatgtatttatgttataatggccaacatttggtcagcccttgtccacttattcacttccctccttttgtaaaataagtgctttaattataaactgtataaaaataccttgtataaaccccttttttgattattacaataaataagctgaattgtaacaaatgaaatttgatttttgtaataaaacagtggaaaagtaaaa

SEQ ID NO: 16473 - DNA, 7812 bp, Homo sapiens
agttggatcaacccagagctattgccttagatccttcaagtgggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatgccacaaatccatgtggaattgacaatgggggttgttcccatttgtgtttgatgtctccagtcaagcctttttatcagtgtgcttgccccactggggtcaaactcctggagaatggaaaaacctgcaaagatggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaaggatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttgggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtgctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccagggctttactgtggttgtgagctcagttccgagtcagaacctggaaatacaaccctatgacctcagcattgatatttacagccgctacatctactggacttgtgaggctaccaatgtcattaatgtgacaagattagatgggagatcagttggagtggtgctgaaaggcgagcaggacagacctcgagccgttgtggtaaacccagagaaagggtatatgtattttaccaatcttcaggaaaggtctcctaaaattgaacgggctgctttggatgggacagaacgggaggtcctctttttcagtggcttaagtaaaccaattgctttagcccttgatagcaggctgggcaagctcttttgggctgattcagatctccggcgaattgaaagcagtgatctctcaggtgctaaccggatagtattagaagactccaatatcttgcagcctgtgggacttactgtgtttgaaaactggctctattggattgataaacagcagcaaatgattgaaaaaattgacatgacaggtcgagagggtagaaccaaagtccaagctcgaattgcccagcttagtgacattcatgcagtaaaggagctgaaccttcaagaatacagacagcacccttgtgctcaggataatggtggctgttcacatatttgtcttgtaaagggggatggtactacaaggtgttcttgccccatgcacctggttctacttcaagatgagctatcatgtggagaacctccaacatgttctcctcagcagtttacttgtttcacgggggaaattgactgtatccctgtggcttggcggtgcgatgggtttactgaatgtgaagaccacagtgatgaactcaattgtcctgtatgctcagagtcccagttccagtgtgccagtgggcagtgtattgatggtgccctccgatgcaatggagatgcaaactgccaggacaaatcagatgagaagaactgtgaagtgctttgtttaattgatcagttccgctgtgccaatggtcagtgcattggaaagcacaagaagtgtgatcataatgtggattgcagtgacaagtcagatgaactggattgttatccgactgaagaaccagcaccacaggccaccaatacagttggttctgttattggcgtaattgtcaccatttttgtgtctggaactgtatactttatctgccagaggatgttgtgtccacgtatgaagggagatggggaaactatgactaatgactatgtagttcatggaccagcttctgtgcctcttggttatgtgccacacccaagttctttgtcaggatctcttccaggaatgtctcgaggtaaatcaatgatcagctccctcagtatcatggggggaagcagtggacccccctatgaccgagcccatgttacaggagcatcatcaagtagttcttcaagcaccaaaggcacttacttccctgcaattttgaaccctccaccatccccagccacagagcgatcacattacactatggaatttggatattcttcaaacagtccttccactcataggtcatacagctacaggccatatagctaccggcactttgcaccccccaccacaccctgcagcacagatgtttgtgacagtgactatgctcctagtcggagaatgacctcagtggcaacagccaagggctataccagtgacttgaactatgattcagaacctgtgcccccacctcccacaccccgaagccaatacttgtcagcagaggagaactatgaaagctgcccaccttctccatacacagagaggagctattctcatcacctctacccaccgccaccctctccctgtacagactcctcctgaggaggggccctcctcctctgactgcctccaacgtaaaaatgtatgtttaccttgctgcctcctccagcaacttggcctctctgggtttcagggcccaagagaaaacagtggaagaaaggattcagaatttgggcaagggtgaagtaactgttcatgcaagttaaaaatacctaagtaaagtttttgaagataaaattgtggtttcagaataatgctgattgttggagactgtaagaatcaggtgcacttgattttgcatataagcaaatggtaaatctatcagaatcctaaaacagacaagcatgaactcttcccattgctggaactaagtgcccacagtgtcagacaaaatggacattgaacttggattctgtgatacacagggcacttgatgcttaaatgaagatggaaaggttagcaatacctgggtgtcagttagaatttgagaattctatatgtttacatatttaaatgtgcatcttgatctggtgggcttcccatgtggagacttgcactctaattaactaagaagaatattgccttgttggatctcagtccacgtgcttgcactgcgatggcaatggcctcttcttcaaaatactaatttgtgtgccaatttgtttaaaattatttgaaggcagttcagcctaatctcagtgttctctttctggggtagatgagatggattcttaatatttctgggagtactttttaatgagagaattgtcaaatttggaaagatttattgagccttaggttacatggacagttaagcttaagtaaactgtatattgattatcaaacacaagctgtaattggaaaagttgagaggaaaagcatgagatcacaaattagggggaaaaaagaaaagggatttttaaatttggtgtattaaattcattgtccaagggggaaaatgaataatgtttcattagattccttatatgcaaaagtatttattttgaacatgtgtcctaaaatatatgcactaactgatgtgattaaaattgtccaagaaataaacttgagcataacatactttgtgtgcaccacagtaagctattctgcattgaagtggtcttttataactaaggcctggactttgctccaacagagtcgtggtcttctgaatagtgacttaaggagttttgtttgcttaagtcagataatagcacattcacagggaaacaaagagagttggtggatagaattttctgactattaatttttcttccatgaaattttattatgcctttggcactttctgccactcttacagcatatcacaagatatctgtttagcagaagattatgtagttactttaattttaatataaaagtagcttgtgatacattaccaagagatctctgattctttagtaagtttgagaacacctattctacagagatgataggtacttagaaatgaagactttaaagtacattttaatctaatataggccagtaattgggggaaggggctttgagcagtacaattttaagatgattttgagggttgtatttctttatcatttaaaaatatcctaaagtcagtaatttatatgaaggaaactcattcattattgaaggtattaaaaatagccatcatctgtattaggtagcagttttggaggatcatctttttcttttgctataaagccctattaatgaagaatacttccagtagagttaatagctgtagcttacctagtgtgttaatgaagtgtgtttatttatgtgacttgataccagtagtcataatagagactgaagaggtatgcgttaagcacgcctacttctatgcagtaaacaggctgcagctgcctagattagattcttagaaatgtcatattttgaattgttttatttcttgtaggggaagctttgtcccacttcattcatttgcatgccataggaattacatattggttatcattacgtatctaacaagattcagaaacaaaaatcttggacttttcacatccgaaatatgtcagctcttaataaatgtgtggtgcttaagtctacatatggcatccatagttgatttagagtatggatatgagtgtgttgaccagttatcagtaggtggacaaatatttgggcatctacagatgagactatgcactaagtgtggactgagtcctaaagaagcttatagtcaggtgttgtttaaaacattatcagaattcttaaacccaaggaatttaattttatttggtatttcttaagcctaaaatgaaccaagagaaagatgattttagaaagtacttgtagtgaaagatgattttagaaagtacttgtagtgcatgtgtggcttctgacttttgggatggcaccattttataatagtttcaaaatttagcttttgaaattctcaacattttatggtagaagactttggacctcaagtataaaattatacgtttataatttttttaaaatttaaattataagtattgtgaattcacactctcaggctattgtctgacttgatctacgtctcataaagcctgtacctgagtggagtggaaggtggagtcttaggttaatcagttactgactctaccctcaccctctttcaattgaggtaaactttgctgtttttctttttcataaagcattctcaaattgttgagtttattgctgaaaaaaatctccatgactttacagatagaattacaaactaaatgatgtcttgtatttagaagcagagtacagacctaacgaactgttagattctccaccatcacttagggtttgcccagaagcaacaccagagaattacagacaacgcgcttttgctgaactgtccattttggtggttgtgtttttcagtcaaatataagcaggatgggcgatagagatatatttatatatagatacatattctatatatctaatgcctaaatatgggtattaaagggaaaatttttaaagtctgattaaatccaatatgacatgaaattaaatatatggattagtaaggaaaaatgttaaaaagtagagaggataccaagaagattaaactggactagccttatttgcaagtgaaggatctggtgctgctttcagatgtttatcttttatttttttcccttaagctttaatcttcgtcattgtcttaaagtcaactggtgtttcttgttcattgactttggtacgatggtgctttgcaaggatgtatttatgttataatggccaacatttggtcagcccttgtccacttattcacttccctccttttgtaaaataagtgctttaattataaactgtataaaaataccttgtataaaccccttttttgattattacaataaataagctgaattgtaacaaatgaaatttgatttttgtaataaaacagtggaaaagt

SEQ ID NO: 16474 - DNA, 2382 bp, Homo sapiens
atgggcctccccgagccgggccctctccggcttctggcgctgctgctgctgctgctgctgctgctgctgctgcagctccagcatcttgcggcggcagcggctgatccgctgctcggcggccaagggccggccaaggattgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctacctggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagacgaagatgagctccatatagggagaactgctcagattggccatgtctatcctgcagcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaagcgagtggcattaagccttgaagatgatggactaccctga

SEQ ID NO: 16475 - DNA, 4467 bp, Homo sapiens
gcagcggcaaccccggcgccgcggcaaggactcggagggctgagacgcggcggcggcggcgcggggagcgcggggcgcggcggccggagccccgggcccgccatgggcctccccgagccgggccctctccggcttctggcgctgctgctgctgctgctgctgctgctgctgctgcagctccagcatcttgcggcggcagcggctgatccgctgctcggcggccaagggccggccaaggattgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgacgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgtccgggccccggggccacgtccgcgcccgccgcctgcgccaccgcctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagacgaagatgagctccatatagggagaactgctcagattggccatgtctatcctgcagcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaagcgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtaccagagtgctcagaaactcaagataggatatgcctcaccctcagctactccttgttttaaagttcagctctttgagtaacttcttcaatttctttcaggacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggta

SEQ ID NO: 16476 - DNA, 2553 bp, Homo sapiens
atgggcctccccgagccgggccctctccggcttctggcgctgctgctgctgctgctgctgctgctgctgctgcagctccagcatcttgcggcggcagcggctgatccgctgctcggcggccaagggccggccaaggattgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctacctcactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagacgaagatgagctccatatagggagaactgctcagattggccatgtctatcctgcacgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagt

SEQ ID NO: 16477 - DNA, 3322 bp, Homo sapiens
gccggggcgggcggcagcggcggcggcggcggcggcgggggcagcggcaaccccggcgccgcggcaaggactcggagggctgagacgcggcggcggcggcgcggggagcgcggggcgcggcggccggagccccgggcccgccatgggcctccccgagccgggccctctccggcttctggcgctgctgctgctgctgctgctgctgctgctgctgcagctccagcatcttgcggcggcagcggctgatccgctgctcggcggccaagggccggccaaggattgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgacgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgtccgggccccggggccacgtccgcgcccgccgcctgcgccaccgcctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagacgaagatgagctccatatagggagaactgctcagattggccatgtctatcctgcacgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaa

SEQ ID NO: 16478 - DNA, 7819 bp, Homo sapiens
gctggagtccgccggcggcctcgccgctgccggccgctcacggaggaactacaattcccaggagaccgcgcggtgggtgggggcggggtagtgggcggggcatcggcaggctaggttttctccgcgcagcgccagtcgcagaggaagatggcgccgcggagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccacccgcttgttggctggtcactaagtgtcctggtggctggggccggagccagtgctcttgaagggatcgcgtcatagccagcttcccctctgggccctgtgggtctttgcagccaacctccttttcccgtgagacggcccggcctgatttaaagccaagagcgcttgagttgagtttgaggggaagatgtggagcgtgtggttctgtggacagtcagagactgtggcctgggggcagcgtctttcaactctcacctctgcagctcagggacctcgggagacctcaccaaacctgcagggcctccgtgtccctaagtgtgctgtgtaaatgccccatctcatgggggagagacagccacggaggccttcctctgaccatagctgatggactggcggttgctcaggtccggctccgagaatgttcctgtgtctgagcctggaagaggctcgggtctggctccaggcgtggttcccttcccgtgtctgagcctggaagaggctcgggtccggctccgagcgtggttcccttcccgtgtctgagcctggaagaggctcgggtccggctccgagcgtggttcccttcccgtgtctgagcctggaagaggctcgggtccggctccgagcgtggttcccttcccgtgtctgagcctggaagaggctcgggtccggctccgagcgtggttcccttcccgtgtctgagcctggaagaggctcgggtccggctctgggcgtggttcccttcccgtgtctgagcctggaagaggctcgggtccggctctgggcgtggttcccgtgtctgagcctggaagaggctcgggtccgggtccagctccgagcgtggttcccgtgtttgaacctggaagaggctccaccaggcgtattgtgttttgactgcagctggatcttggcttgactgttgagatctgccaaacatccgctaagctatcatttctgagaaaggtcaaggctagaggcagcatgtcgggagttggcgcatcagggttggaagggccccagggtacagcatgtgggtgcctgttcctttgtggacttgtgtgtgtgtggctggtggggcggggggtggattctggttcttttttttcccattatcctgagagccttaaggtactcagtgtgttggtgagactcagccctgtcatctagcagaagtgtgttccttttcattgctgtatagtattccattgcatgactgtcctgtgctctgattttaatgcactttattgtgggtggatatttgagttgcttcctttctggggtaataacactcacttggaaatagctgtggtgaacactcgtgtgggggtgggggtgggggccaactctaggagcacctaatggatcttacgaagcgtgttgtccaagtatagagatgattccaaagtggttggactgtgtttctttctcccagctgggtggaaggagaacactagtggattgctgagacttggtgctcggtatttttaattatggacagcctggctggcgttttgtggtgtctaattgcggagtagcgtgtcttactgtataatggcctcttttgtatgtgggagaccatggtgttgaggggaggcagttacacaaaaaacccagataccgagtgttagttccatgggtgtggctggtcatggtgcgcactcacgaaggatgtaggtgatgccctccactccgcagagccagtcccacaggggtacccattctgactcctaccaccgcagctccctacctcccgcctgccatgggttccacgtgcatggctctgggcagtctgtgtctttgcgtgcgtctgtgtatgtctgcgtgtatctgcttacattcgctcagcatctgagattcacccaggcttttgcgtggatcagcggcagactcctgattgccgcgtggcggcctgttgtgtgggtgtgtgccgcgtgtgtatccagtccctactcaggagtgtacgtttccagtgtgggttgcagtcaggatccatttctcccttaactttcagattatttgctgcataggcttttttctcctaatttggcgcctttgtcagaaatcaactgacctacctgtgtgggtctgtttctgtttgtccttacgctcttgccattgccacactttagacaaggtcttgctctgtccctcaggctggagtgcagtagcgtgatctcagctcactgcacccttgacctcccatactccagcaatcccctcgcctcagtctcctgagtagtagctgcgaccacaggcgtgtgtcaccacacccggctgattttattttttttatttttattttttttgtagagacggggttttactatgttgcccaggcaggtcttgatctgggctcaagtgatgctcctgtctcagcctcccaaactactgggattacaggttgtaggtgtgagccatggtgcccggccgccacactgtcttggctacagttgggtttataataaaccctgaatcgaggtgatgtgcattttccaactcttctttttaaagattcttgtggctgtttatgtccttggtgtttccatatatgttttacaatcagtgtctcaatttctaccaaaaaaacatgccttctggaatttcaatagcaattcccttgaacgcatttttgaataccttttctgaatgtcttgaatacatgttgggaagaatcggtgtcttaacagtctccagtgtccacgcgttgactgccgtgtgtgactccagtcggcgtctcaacagtctccagtgtccacgcgttgactgccgtgtgtgactccagtcggcgtctcagcagtctccagtgtccacgcgttgactgccgtgtgtgactccagtcggcgtctcagcagtctccagtgtccacgcgttgactgccgtgtgtgactccagtcggcgtctcagcagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccatgcgttgactgccatgtatgactccaggtattgagttcatcttcaacttctcccaacaatgaactggagttttctgtgcatgtgtctggcatgttttcctttagatctagtcctaggtgttcgatatgctattgaggactgtgtatttttatttcatttgtcacctgtgcgtggtgctttaatcctgtgccctaaactcccgccttggccatggcggtgtttctgtggactcgtggggtttccgtgtgcacacgcgtgtcctctgtctgacagtggctttgcttccccttgtcagtctgtgcctcggcttctcactgcactggtgaggtgagccggcgctcgctaatcttattcccagtctcggtgaacatgggctcagtctctcccggctcagtgttgggtttgcactggtgcacttacaggcagaagagcttcctcatttgctgagggcttttcctgaatccgtgttgaatgtggtcagctgcctttcctgcacctagtgagatgctcatgaggtcacttccttaccgcattactgtagtgaattacgctgactttcatatgccaagatgacctggcatttccaggtaagtccctgtggccatggtgcattggccttttctctgcatggccagatgagatttgctcataccgggctaaggacctcctgtgtaggaatgctcttgagggacactgggcttggatgttcattgtcttgtcatgtgatgtgtctgtcatggtttgatattgcattaagtgggcctcctgaaacaagttctgccatagtttgtataggattggcattatttgtttcatagagatgtgatgggtgaggccatctatgcctgccattttctttttgcttaggtttttcattaagaacttgatttttaaaaatagacatgaggcctggcatggtggctcacgcttgtaatcccagcactttgggaggccaacgtggatggatcacctgaggtcaggagtttgagaccaacctagtcaacatggtgaaaccccgtctccattaaaaatataaaaattagcagggtgtggtggtgcatgcctgtaatcccagctactctggaggctgaggcaggagaatcacttgaactcaggaggtggaggttgcagtgagctgagatcacaccactgcactccagcctgggcaacagagcgaggctctgtctcaaaaaaaaagacatgaggcttttggattttctgtttcttcctttgtcatttttttaaagataggtttgtcgcagaatttcatctaagttatcaaaacaatttacataaatcattcacagtatcctctgtgcagtgatgtccattctcattcctgctctgggccatttgtgttttcttttccccctgatcagactagctaagagtttatcatttttacagatattttccccaaagaaacctacttttgggtccattgattttttttttctattgttttctttttcattgacttttgctcttttcttatgaatttcctttcttctacctattttgtgttcaatttgctgtccttgttttaggttcttttgatagaggcttagatcattgatgaagaatatgaaagaatgggataatacagttaaaaacttggtctacttatgcccattagagaaaacattcttaagcacgcatggaatcttttaaaaatggacgaggtactaggacccaaagcaaatgtcagtaattcgcagatgataatgtataaatatatgatatgtaggtaaataatacaaatcacattctttggccagagtgcaattgaggaggaaatcagtaacaaaaagacaattaaatccatttgattcttttgttttcgttttgtagtaacttgcacttccctggtgccagaggcatgacacctttttgtctgctcttggccatttgggtggcgtctttgggaagggcctacttaattcttttgcctatttaaaaaactgggtcttggaaatcttgtctttttttttgagtcaggatctttctcgcacaggcttggagtgcagtggtgcgatcatagctcactgcaacctcaaactcctgggctcaagcgagcctcccacctcggtcttctgagtagctgggactacaggcatgcatcactatgctctgctaatttaaagaaaaggttttttttatagagactgggtctcgctgtgttgcccaggctggtctcggagtcctggtctcaagtgattcacctgcctccacctcgcggagtgccaggattacaggtggcgggagccgccacacccagcctggtcttagcgttattcccaggtctaggtgtgagtccttcctcagatatgtgttgtgaataatttccgatcctctggcttgctattttactttcttaatggttatcttttggaaagcaaaggtttccagtttgatgaaatctaatttttattttttatttttccgttctagtggtctttctattttctcatcaaattgagactttggggaaactacacagcagcaaaccaggatatatcctcttaaaaacagctcgagccggccgggtgcggtggctcatgcctggaatcccagcactttgggaggtggaggtgggcggatcacgtgaggtcaggagtttgagaccagcctggccaacatggtgaaaccccatctctactaaaaataaaaaattagccaggcatggtggcaggcacctgtaatcccagctacttgggaggctgaggcaggagaatggcttgaacctgggaggcagaggttgcagtgagccgagatcgcgccattgcactccggcctggggacaagagcaagacttcgcctcaaaaaaaaaaaaaaa

SEQ ID NO: 16479 - DNA, 1147 bp, Homo sapiens
ccgaaagctgagggacggaggtcagtgactctggggtctcgggaacccggagacgaaggaagacaccgtgttccttaagagggagtatacgtttcctcgccatttatccaatggagtttcctcttacctacttaacaggaacagggaaagggtgtcccccaacggtacggctgccccgcctcttcctgggggcccacacgtgttacaggaagtgggtaagggtaatatggaggagcttccggcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaaatgaactatatgcctggcaccgccagcctcatcgaggacattgacaaaaagcacttggttctgcttcgagatggaaggacacttataggctttttaagaagcattgatcaatttgcaaacttagtgctacatcagactgtggagcgtattcatgtgggcaaaaaatacggtgatattcctcgagggatttttgtggtcagaggagaaaatgtggtcctactaggagaaatagacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtgaaagtgacatcctggccacctcacgcatttgatcacagactgtagagttttgaaaagtcacttttatttttaattattttacatatgcaacatgaagaaatcgtgtaggtgggttttttttttaataacaaaatcactgtttaaagaaacagtggcatagactccttcacacatcactgtggcaccagcaactacttctttatattgttcttcatatcccaaattagagtttacagggacagtcttcatttacttgtaaataaaatatgaatctcaaaagtgtcatgttatttccaa

SEQ ID NO: 16480 - DNA, 2308 bp, Homo sapiens
aggatcccgccccaaccagcgccaggccacgccccggcgtgtgacgcaagcacgctccgtgcgcgccgtcgcgtcgcggcgctcactgggggcccggctttcgcccgctgctgccgccgccgccgccggccgcggctgcactcccaagatggcggctcctccgggcgagtacttcagcgttgggagccaggtgtcgtgccggacgtgccaggagcagcggctgcagggcgaggtggtagcctttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaagcttgccagcaaagcacggacagagaaggaggagaagctgagccaggcctatgcaatcagtgctggtgtctctctagagggccagcagctcttccagaccattcacaagaccattaaagactgtaaatggcaagaaaaaaacatcgtagtcatggaagaagttgttattacacccccatatcaagtggaaaactgtaaaggcaaagaggggagtgcactgagccatgtacgcaaaatagttgaaaaacattttagagacgtggaaagccaaaagatactgcaacgttcacaagcccagcaaccacagaaggaggctgccctgtcatcctgagtccgtacacatggaggactcttccagcatccagccaaggaggcgctggtggtggcttcagcggaggcaggccgggggagggaagggatcctatatgtcctgttggctcttaacaaagggtcagcatttccaaatcttagacttgaacaaacaaaacacccaacaaaaaagaacaagagaataatttaaaagttgaatcattacttgactaacagacttcggtccaccatgtccttttcacagccctcttctggaacagtcaccttgttaattttatttttgaaaattattttcccactctgccctttacttctgactttcctttcctagtttgttcctgccattctgtttttataagtggctacacttgccttctgaatgattgaaagaaacttttacatcttttcttccaaaataaaagtaacaagctgactgtgattcttaaattgagaccagagcagcaaacgtctcactttaaatttttgttttcttttcctttttttttcttttttctttttttttttttttttgcacagggcatggcttgaattagttttatttttcttaactttaaatatatatatgaaaatatatattaaaatgttctctaaatattttctgcttcttgcaggtctctttttactagatcatggctgttcttcccacctcatccctctgaaaataaaaatgtattgccctccccaccatccatcatagccaggccactaacttgacttggtgcaagagattcttgctgcgaactttgtagagccagtgtgcagatagaatttggctttgagggttcctgatggctttttagtctttaactgtgtgtgtaccagtctcacatttggcccaaacctcaggattctccctctgcctgtcttacttcatggtactagaagaccttcctcgccactctctccacatgagagagtcagctgccctttctcctgtgcctctgcaggaagaactctcttgcatggcacatctcagctcctcattgagggatagttttctttgataagaaacctggagtccatttactctgacctctctttaaatctatatccagagccactagcccaggaaaaacttgggtgacccgtaatttctcttctcctgctgtccttttgctcttacgccccaccccaactccccttaaattttacaggcttatgacagtttgtatgtgctcagccaatgagcagaaaacctggaaagaatttctggactttagcccaccagtttgtctggttgactaacctgctgagagctaaaattggcacccattgccccgtgccttcaggcagtctcctggggcagagtatgccaccatccgaatatcaggcactgagtgggatgtgggtgatgctcacatgactggctagagctttgggggtggggtgggggttaactactatttttttggccatgatctctttccccttccttttttttttaattaaataaatggatcaaattaaataattcaagccctgccttcaaaatgaaattttttttttagtattatttagcaaaaacaataaaacccaaatttttttaaccatc

SEQ ID NO: 16481 - DNA, 2484 bp, Homo sapiens
agcagtaaatagcaccgtccttggaaataggcagactgtttttgctagttgtggaaccgtggacaagtttagtctaaaacttagtttatgtaaaaggaggacattgattcctacctcaaagggctgttagatgctcaagaagtgacaatacaaatgcctatgaagaaacaggatcaggatcccgccccaaccagcgccaggccacgccccggcgtgtgacgcaagcacgctccgtgcgcgccgtcgcgtcgcggcgctcactgggggcccggctttcgcccgctgctgccgccgccgccgccggccgcggctgcactcccaagatggcggctcctccgggcgagtacttcagcgttgggagccaggtgtcgtgccggacgtgccaggagcagcggctgcagggcgaggtggtagcctttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaagcttgccagcaaagcacggacagagaaggaggagaagctgagccaggcctatgcaatcagtgctggtgtctctctagagggccagcagctcttccagaccattcacaagaccattaaagactgtaaatggcaagaaaaaaacatcgtagtcatggaagaagttgttattacacccccatatcaagtggaaaactgtaaaggcaaagaggggagtgcactgagccatgtacgcaaaatagttgaaaaacattttagagacgtggaaagccaaaagatactgcaacgttcacaagcccagcaaccacagaaggaggctgccctgtcatcctgagtccgtacacatggaggactcttccagcatccagccaaggaggcgctggtggtggcttcagcggaggcaggccgggggagggaagggatcctatatgtcctgttggctcttaacaaagggtcagcatttccaaatcttagacttgaacaaacaaaacacccaacaaaaaagaacaagagaataatttaaaagttgaatcattacttgactaacagacttcggtccaccatgtccttttcacagccctcttctggaacagtcaccttgttaattttatttttgaaaattattttcccactctgccctttacttctgactttcctttcctagtttgttcctgccattctgtttttataagtggctacacttgccttctgaatgattgaaagaaacttttacatcttttcttccaaaataaaagtaacaagctgactgtgattcttaaattgagaccagagcagcaaacgtctcactttaaatttttgttttcttttcctttttttttcttttttctttttttttttttttttgcacagggcatggcttgaattagttttatttttcttaactttaaatatatatatgaaaatatatattaaaatgttctctaaatattttctgcttcttgcaggtctctttttactagatcatggctgttcttcccacctcatccctctgaaaataaaaatgtattgccctccccaccatccatcatagccaggccactaacttgacttggtgcaagagattcttgctgcgaactttgtagagccagtgtgcagatagaatttggctttgagggttcctgatggctttttagtctttaactgtgtgtgtaccagtctcacatttggcccaaacctcaggattctccctctgcctgtcttacttcatggtactagaagaccttcctcgccactctctccacatgagagagtcagctgccctttctcctgtgcctctgcaggaagaactctcttgcatggcacatctcagctcctcattgagggatagttttctttgataagaaacctggagtccatttactctgacctctctttaaatctatatccagagccactagcccaggaaaaacttgggtgacccgtaatttctcttctcctgctgtccttttgctcttacgccccaccccaactccccttaaattttacaggcttatgacagtttgtatgtgctcagccaatgagcagaaaacctggaaagaatttctggactttagcccaccagtttgtctggttgactaacctgctgagagctaaaattggcacccattgccccgtgccttcaggcagtctcctggggcagagtatgccaccatccgaatatcaggcactgagtgggatgtgggtgatgctcacatgactggctagagctttgggggtggggtgggggttaactactatttttttggccatgatctctttccccttccttttttttttaattaaataaatggatcaaattaaataattcaagccctgccttcaaaatgaaattttttttttagtattatttagcaaaaacaataaaacccaaatttttttaaccatca

SEQ ID NO: 16482 - DNA, 876 bp, Homo sapiens
ccctttcccggcttcctcctcccctctactctacccagcttgcgctccccagccgcaagtcggccgcgctttgcccgtcagcgcttggagctttctgcgtcgcttcccgctgcgcctgcgcggtcccgcctcgccccacgcgcgggctcgcgcttcggtttccccagacctgctcgcagcaccctgctgtcttcccggtccggcccgctgcccgcggcgccagcaccatgctcttctattcttttttcaagtcccttgtgggcaaggatgtggtcgtggaactaaagaatgacctgagcatctgtggaaccctccattctgtggatcagtatctcaacatcaaactaactgacatcagtgtcacagaccctgagaaataccctcacatgttatcagtgaagaactgcttcattcggggctcagtggtccgatacgtgcagctgccagcagatgaggtcgacacacagttgctacaggatgcggcaaggaaggaagccctgcagcagaaacagtgatggctcctcctcctcttcccctccctctttcattggtgacccataaccccaagtcccagcccagaacccctaacccccaatacttgaaggggttttgtttttttactaatgatggttttgtgggttttttttaagggatgagtggatgagaggagtaatagggaacagctatcctctcttgagaaggggaggataagtaggctgggaaacttcaaagccttcccagtccccagcacctgcctttctcactacttctctggagatggtaggagagtttcctaggtctttccagggcagcatgtgattcatttggggatggaaggaatctgtcccgcatcgggaataaaatttatgatgcaaa

SEQ ID NO: 16483 - DNA, 876 bp, Homo sapiens; identical to SEQ ID NO: 16482

SEQ ID NO: 16484 - DNA, 876 bp, Homo sapiens; identical to SEQ ID NO: 16482

SEQ ID NO: 16485 - DNA, 876 bp, Homo sapiens; identical to SEQ ID NO: 16482

SEQ ID NO: 16486 - DNA, 876 bp, Homo sapiens; identical to SEQ ID NO: 16482

SEQ ID NO: 16487 - DNA, 876 bp, Homo sapiens; identical to SEQ ID NO: 16482

SEQ ID NO: 16488 - DNA, 3815 bp, Homo sapiens
gcgcagcaacctccaccaggcctccgcgtctggactcccgccctgcctctgggcctcctccgcccaccggcggcgtctcccgcgaagcccgctgggcctcgctctcaccctcctcctcctcctcacgccgggccttgctcttggccttggatttctggctgcgcagttcgcgtccccgcggctccccgccggccgcgcgtttccgagccatgttgcttgtctgggcaaattccacttcgcgagtgacgcacccggccgcgatgcgctagaacgccggccccgccccgaggcggtgcgcttggccacgccccttcgttggaggcctagtcacgcccctaaaggaagctccaccccatacccgtggccactaaaaaactgcgggaagcaggaaagagcacaacaggtttctctctatttccggtgtattgtatcctcacgtttccggagattgacgttgctcttgtgttctcgcgagaggcgggaaagggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcagaactctttcaggacttcttttgctccattattctcacagatacttactgatttttcttttctttaaattggtgtttccttgtagatttttttaagtgcggtcttctgtcttgtgaattatttaaagtaagcatgtcttaccttcacttagcacacatttgcagtgcacctactgtgtttgaggcaccaggtttgagtgctgggaaccagagttttatcaaaatgctttctgggccagacatggtggctcatgcctgtaatcccagcactttgggaggccaaggtgggtggatcacctgaggtcaggcgtttgagaccagcctggccaacatggtgaaaccctttctctactgaaaatataaaaattagccaggcgtggtggcgcatacttgtaatcccagctactcaggaggctgaggcagtagacgcttgaacccaggaggcagaggttgcagtgagccaagatcacaccattgcacttcaacctggtcaacagagcgagactccgtgtcaaaaaaaaaaaaaaaaaagttttctgccctcaagtcttctggggaggcagatgtttaaaccaacaattgcaggcagtaagattagtgctgatagaatcatgcacatgcaggatgccataggagcatggggaagagcacccaaatatgggagaaaggggcagagggacattgtaaacatcaaccctgcagtagaagacagagcaaagcatgatttctcttttctctggcctgatttaattctaaggtcagacgttcagcttgatcataacctgtttataattatgactcagaccatttttccactcttggatcattggccattaatgatgaggggtctcaaacaacatgtctcagtgacacagtaaagcagaaattggctgaaagcaaagctgtttttatttctagcttcagtcagcacataatgcttaaaacctaaagaggaaagtaaaagcgtgttacaatctctcaaactttatcaagacagggcttagaacctgacatcctccgctatggtcattccattttgaaatgtagaaaatccaacttgtggatggtttgtctgtaaatgagctgaatgtgtgtgcgtgttcattatcaagcacgatatgctcacaaatgcacagtactttaagccttgtgcaagaaagatgctttcagtaaacatatttaaaaggttttattttccttactaatggtacatgcccctgcaagttcatggagaagagaaaaacaagtgtgggtgagctgatggaggcttcatcttaggtgaggaggcaggagagacaccctcccttcacttgtgccatccccacgctttgtccttaagctgtagtggtcccaggagataacctgtttacagcagcccattcagtattgaaaaatgaactccctcctgcagaatgttagaagaaacaacctcaaagacctcaggccgcctgtggtcattagtatgtggcagcaagattgaacctgcctgcctcctacctgtgtgagcctgtggtgtgggtgtggtaccaaggccctggctctgggcagtctgttggctcctggtgttcactaaggcgtggggtgacaggccatctggcctcgctctgccagtctgcagttctccccagcactgcattcatttttagtggtttctgatagtcacactgaattcctggacactttcttctcttcattcttagttatctttctcctttttctcctggaactgatagtttacactaaaacttttggctgtgaggacttgattatacacatttctaaaacccatgaaccttaatatctgacactgttactctcatatgcacacacaactaaaacataccaacctacttcatttcctagctgctaagatacaaggggagggacaataaaaggttaactgcagaatagccacctatgtgtcaggaaatggagggaggggaggcaatgtgtgagtccttttggagctgggactcaatccacaacagagacagctcaagcagggccctgccatggtccacactgaggtttcctctgcagtggtgctgtccactgaggggttatggtgtgagggcccctgggagccacgccttggacttctgagtctgcagagcactcggctccagccagctggatggcaggtggtcagtggagctggtgactggtggtttctgcaatgaggtgtcagattagcctaagggaagcctcttcagcaagtatcatgcctggatcccggtcttggttgttttatgagaggccgatatgaattgccattgcctcccacaaagaaaaatggacaaaatatgggaccacatctttgagatgaaatgtgcccaaaatgaaaagtaacttgagtatcccaagttaaacttaatcattagctgcaaatggacgattttcaaatttcaaatagtgatttttgaagatttgcccaaactagagtactatccctcttcacactaagaggcagaaagtggtttcacacacccttttatttaatcagctaaagtgggtgcggtgacacacacctgtaaactcaaccactaaggagactgaggcgggaggattacttgagcccaggagttcgagatcagcctgagcaacataacaagaccctgtctcaaataatacttagctattacccatattgcttttagcctgctgccaggaggggagaaatgttattgtttgaacagatgtcagatgtgagtaatgctcagctgtgttcaatgtagaaaattaataaaagttccaggagtcatcctggctagatcaa

SEQ ID NO: 16489 - DNA, 1908 bp, Homo sapiens
attacaagccgcggcactttacggctctcgtcctcgttcctccggcgggaacacggcccgccccgccctttcgcccagcgggccccgccctactccgcgtggattggttgaccgcccttcgagcccggtgctgactggcttgcgtctctgccactttctttcagcttagtggcgcgcggcgcggcgacgaccgccgggagcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaaactggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactacacactgcacatccactgttccttttgagcttctgggtgcacctagcgggtctcctgccctctgtccatcgctggactctcaggaaatccccgttcccgtaagggaagcttccttttgagagttctcaccaggtgtcagcggcacagtgaggcactgatgtccttttacaaaaggcaagaccagcatctggacagtgggggctcttgagagtccccggcgccccccacaccaggttgtcctataaccctctcccctctgtggagacgttaatgccaaggggtgtgtggggagggaagtcccaggcaggggccacgcatggtccccatcaccccctcctgggtggcctggactccatcatctatcctcatctgtccacactggcgttcacacagagaagacaggacaggaatcccctcggaagatgctcatggaagattctcacgaggctcctgccccctttctgagccaggccgggtttgccactcctcgggcgcgcacctgagacactgagtcagcgctttcgagaaaggctccgggtagcatctgtggaccgtgaagaaaccagagggaagccctgagccaggcagcggcccgtccccctgcatagccttctcttcagggtcctcgttcggagacctattttgagaggtgattggaataaaaggtcccgtccgtgaggaactcttt

SEQ ID NO: 16490 - DNA, 1145 bp, Homo sapiens
cccgccctactccgcgtggattggttgaccgcccttcgagcccggtgctgactggcttgcgtctctgccactttctttcagcttagtggcgcgcggcgcggcgacgaccgccgggagcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaaactggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactacacactgc

SEQ ID NO: 16491 - DNA, 2251 bp, Homo sapiens
gcttttcaaagtcgtcccaccatcaatgaaggcaggccacttccggcgtagccatggcggctaacgctactaccaacccgtcgcagctgctgcccttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtcattttgtttattctactgcagtagccagtggaacaaagtttgtagttattttgccacttacttttctgtcattatatgcttatttgttttgtcatttacgtgaccatttgattctcaaacaaaagttgttccaaacaaaatgatgaactttgatttgaacaggtgcatttaaacaaccggaaatgatcacttagaaaattcaattaaaatgctgttgttttgtaatgaggatttttcttctgatttcaaattccatgaactcctattgaaaacaaacaatgtacaggtaatatatgcacattgtagaaatgcaggaattatctattggaattaccctaaagatagaaattttatctatttgcttataaaattgattcagaaggttattaccttaatgtagttattactgaattgccaggaaatgagtggagacagagctttaagataaaggatactaaaagcagctaagaactccaggactcaggtcaaatcaaggaactgataataagatcattgaactgtataaattaagtcaaagaactcctattaaaaacaaacaggtaatatatgcacatcgtagaattgtaggtaagcaaaaaggagaaggttgatcatgctttgctgtatgtcttcgtagactttctcagtccactctcagtacacgttttattttacttgctcatcctgattatactgtttttaccctccacttaagtcattttttgaatttaaatggtgaatatctttctgtgtcaaatatttcaacattaatatgtacatagtattaaatggatttactataaattatttagcctattcttactggccacagtagtctaactagatctttatacatttgtatttttctagaataaactcaaaaatgtgtaagatcaaagggtatatattgtgttgccaagaaaaagtttgtgccaatgtatatttttgccaggagtctttcatagtaccatttatatccttcccagcattagctgtgttctaccttctctcctctttgccatttttacaagaaaaccgggcatgtctaaagttttcttttcctttttttttttttttttttttttttggagagtctcactggaatgcagtggcatgatcttggctccctgcaacctccagtcaggctggtgtgccttgtcgcgatatcaacgcgacctccgcctcccaggttcaagtgattgtcctgcctcaccctcctgagtagctgggattacaggtgggcgccaccactcccatctaatttttatatttttagagagatggggttttaccttgttggccaggctggtcttgaactcctgacctctagtgatccacctgcctcagcctcccaaagtgccggtattaaaggcatgagccaccaggcctggcctaaaattttcttgattaattttgatctcatttgtattttgtaaatgacttatctgttgaggcttttgccattgagatgtttgtctttttcttactaatttgtaagaattcttgatgggtttctgttagtcatgtattttgctaataatttccctagtttgtagtttgccacttagtgctatttttgacataaatgatgtattttaatgtagttgcatgttgacctagtccattatggtttttgtatttggtccacgtggattggaaaacctttgctttgattatacttttctttgggc

SEQ ID NO: 16492 - DNA, 768 bp, Homo sapiens
gaagagcactgattggctgaggcagaaaagtgcccctgcctcggcgctttcggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacatgtgagtaagataaatgtatacaattgtggatttaattgtgaaatgttctttcacttgtaagtttcagtcattttcttttacctcgttgtcagtgtacagaatgctaaaataattaaaaaaagacaaaatatacctcttcctacaagattatttaacttaagtttcgagaagtgtcatttcatttgacttgcttttcttatccagctaaaatgatgcatatattttatatattgtatggacatataattaaaacattttggagg

SEQ ID NO: 16493 - DNA, 1352 bp, Homo sapiens
cgctttcggttttggctgggatcatccgcggcggccgggctcgtggggcgcctggagtgagggttctggttcccgccggcgaggtgagccgcaccgctgcgcgggccgacgacggggccgggcgcagccccaggttcggtgccccagtgttcagtcgcgctgtggagcggcggctgcagcggccctaggccgggcgaggcagccccggaaagggcctgcggtgaacaggctggggctccgggaagggaccgctgggtggcgggtccccgcgaaatgccgcgtccaagctctccgcgcatggaatggctgggagaggtctgatggtgggcgccgggaccgccctcagcgaggcgcctagactgcgcggagaggagcggcaccgtcccggctcctaccgagttggcgtccgagatcaattcaggttgttgaagttccccagggagccccgacgctaatcccaagattcggcgggaaagcggatcccgaacccaggcctaggcttcgcctgtcttccaggagggcttcagggaattgcgaaccctctcctacatcggggtggctgcgcctgaccacaggaattaaaggctggactcgcctgtcttaccaagttgtcaggtcgaggaacccgattgtatggtcttaagtcctatcgcccaaggttttctgtgcgtatgcgtgtccgcacacctgcatagcaggcatttttaaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacatgtgagtaagataaatgtatacaattgtggatttaattgtgaaatgttctttcacttgtaagtttcagtcattttcttttacctcgttgtcagtgtacagaatgctaaaataattaaaaaaagacaaaatatacctcttcctacaagattatttaacttaagtttcgagaagtgtcatttcatttgacttgcttttcttatccagctaaaatgatgcatatattttatatattgtatggacatataattaaaacattttggaggaa

SEQ ID NO: 16494 - DNA, 549 bp, Homo sapiens
gatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacataatccttgcgtgaatatgttctacaaaggcatccagtttcagtctgaagctacaaaaaggggccacaggatcagaagttcagccactgattgagtcacctaaataaa

SEQ ID NO: 16495 - DNA, 545 bp, Homo sapiens
gaggcagaaaagtgcccctgcctcggcgctttcggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacatagtctcactcccatcgcccagacttgagtgtagtgatgtgatcactgctcactgcagt

SEQ ID NO: 16496 - DNA, 518 bp, Homo sapiens
gtcaaagggcgcggggcggtgcctgcgaagagccacacggcgcgacaagatggcggataaggagaagaagaaaaaggagagcatcttggacttgtccaagtacatcgacaagacgatccgggtaaagttccagggaggccgcgaagccagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccgggggcgcggggggtgcagggcaggcccgagcagctcggtttcccgcggacttggctgctgctcccaccgcagtaccgcctcctggaacggaagcattttcctttttgtataggttgaatttttgttttcttaataaaattgcaaacctc

SEQ ID NO: 16497 - DNA, 1456 bp, Homo sapiens
gaaagagccgagtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctgaggctgcggggggtttctgctg

SEQ ID NO: 16498 - DNA, 2097 bp, Homo sapiens
tcccccgcggcgggaaagagccgagtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagtgagcccttctctgtgttcccagggtctgctgagggccgtgtctggtggggatggggctgggctcaccctcaggagtagggctggggagtcgtgaacgggactcaggtgtgggaagaggcgagagggctgtggaggagctcgcacggcgccaggtgatgggctgcacaggcactgtcccctgcctgcgtcctggggcctgtgcactgttgcgtccatgctcagagtggctgagacttgtgtcctgaccaggccctgcttacctctgttttggtttttgtttttgatatttttttttccattgtgtttttacgtagtgtcatgttctgtgcatatagtgttgtattctcctttgcactgtttatgttacagtgaaggctctccttattaaaaatcttcgcaaaggtcactttttaatggctatctaacactccatatgtggtgggcaagtctggttggcctccggggggtttccaggtataggggatgtagggccttgcctggcctggtctgcgggtccatcgtcagtgcctgagcggccagcagaaggggggcagcagcctccactgagcctctggttcccatttcccaggttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctgaggctgcggggggtttctgctg

SEQ ID NO: 16499 - DNA, 1335 bp, Homo sapiens
gtggttcatggacctctgattagcttgggttttgcagtctcattgccacatgtatatgtggagccaatggccttttggtgctcagctgtttacgtctgactccttgacttctttggtacagtgatggagtcagatctcattaagtgtgattctccatgatataactagcctcaaaaaaatgtgtattccactccagttgtaaatatctttagatcagcttttcattgcatttgatggggagaacacagaaatgatagtctgcaaatcatccaggtgaattgttatactagttattttttggtggttaatgtgataatattgtcttatttaaaaccacaaatgaatttcaggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagtgagcccttctctgtgttcccagggtctgctgag

SEQ ID NO: 16500 - DNA, 1504 bp, Homo sapiens
tcccccgcggcgggaaagagccgagtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctgaggctgcggggggtttctgc

SEQ ID NO: 16501 - DNA, 498 bp, Homo sapiens
gccagcgcttgacagtcgttaggtaggttgtactgtgtagggaggagctcaagatcatgatggttgtcacaggagaaagcggttgcatctttgcaaaactatatacctgctgtggtttgtgttttcttttctgctgagtaatgaagttgtaagttcacactggcacattctcagggctgtgcagattatttgcactttatttcataggtgaataagtgctttttagctttctttgttcagtgtatctttgcctgcctacatcaatctgcaagggagttgcagaaagcctcatgttcatcgagccgagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagat

SEQ ID NO: 16502 - DNA, 695 bp, Homo sapiens
gcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggag

SEQ ID NO: 16503 - DNA, 423 bp, Homo sapiens
tcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactca

SEQ ID NO: 16504 - DNA, 833 bp, Homo sapiens
tttgcagtctcattgccacatgtatatgtggagccaatggccttttggtgctcagctgtttacgtctgactccttgacttctttggtacagtgatggagtcagatctcattaagtgtgattctccatgatataactagcctcaaaaaaatgtgtattccactccagttgtaaatatctttagatcagcttttcattgcatttgatggggagaacacagaaatgatagtctgcaaatcatccaggtgaattgttatactagttattttttggtggttaatgtgataatattgtcttatttaaaaccacaaatgaatttcaggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgtgaaaggggggaccctaccctcagaacatgagggaataatatttacgtggctcacaaagaccagcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgag

SEQ ID NO: 16505 - DNA, 2288 bp, Homo sapiens
atgcctgcctacctcaatctgcaagggagtgtcagaaaggccccgcattcgccaagccgagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaacc

SEQ ID NO: 16506 - DNA, 2645 bp, Homo sapiens
gacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaacc

SEQ ID NO: 16507 - DNA, 1525 bp, Homo sapiens
caatttgcccagcgcgctgtgctccgcgacggcgcatgcccgcttttgcgcaggcgcggggactacggcgcaggcgcggagactattgcgcaggcaagcgcgtacgcagaagcgtgcgcgcgcccgttcaacgtccggagcatcggtgcagtttcgaggccttcacagttgttgatcacatagcatggtcatccactcacagcttaaaaaaatacagggagcatcggagagaatgggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcct

SEQ ID NO: 16508 - DNA, 1661 bp, Homo sapiens
accacgctcggagaaggacaggacaatggcggccttagggtccccgtcgcacacttttcgaggacttctgcgggagttgcgctacctgagcgcggccaccggccgaccctatcgcgacaccgcggcctatcggtaccttgtgaaggctttccgtgcacatcgggtcaccagtgaaaagttgtgcagagcccaacatgagcttcatttccaagctgccacctatctctgcctcctgcgtagcatccggaaacatgtggccctacatcaggaatttcatggcaagggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattcttt

SEQ ID NO: 16509 - DNA, 2565 bp, Homo sapiens
gaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgtccgcccgctacgccgccgccatgtcggcgcaggcccagatgcgcgcgatgctggaccagttgatgggcacctcccgggacggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaacc

SEQ ID NO: 16510 - DNA, 2411 bp, Homo sapiens
gtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggttcaatgtatctatgcctgcctacctcaatctgcaagggagtgtcagaaaggccccgcattcgccaagccgagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatca

SEQ ID NO: 16511 - DNA, 1972 bp, Homo sapiens
gtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctg

SEQ ID NO: 16512 - DNA, 370 bp, Homo sapiens
gtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttgatgtatttggaagaggagataacattagagatgtcagcaaatttttggaagatgacaagtggatggaggagtag

SEQ ID NO: 16513 - DNA, 7040 bp, Homo sapiens
ctgggcgtgtcccacgggcgcacggcatgctgggaaggcgtccgcgcggcggccattttgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctgaactagtcccctgttttaaatacaagagttacactattactagaggtgttggtgtacagttttatctgatttgttctgtttaagactaatttttatagactttctaatgttttaaataatggtgcttcaattttaggtggttatgaataaatttgaattttgcttttaatagcaaagatgtgcagtgaactagaatatatttttacatccctgagagattcatttagtagaaaattccaagtatcctgacaagcactctttagctggctagctatgggatgatgtagaaaagcattcaagagctagtttttgttaagtcctgtatcaagattaacccagctgtgtcagtttataaatgtatttgtgtatagggtgtgtagtatatatggcaagggttttttccccccacttaagtgattatttttgtgtcacatctaggaaaaccggcagcatgtttctatctatagccagcttcttcgactgtataaaagtattctctccagctacgtatatacacacatacatatatatcatagcaattccttgtggtttataacttgcaaatactgctatcagtttataggtaaagaaacagtgtgttaaatgacttatccagggagggtcctgtggcttcatgtttatggagttgctaggtctctgcctcatggtccagtgcctgttaagccactgtgttcattctaataggcataatgaattgttaaagaatttactaaaatctcttccaccaaactttgaaaaataatgaagccgcccccactttagaggctctgtatgaaaaaatgctgtggagacagagccctcctggctccctagctgatcctggagatgcagcaatagatgaatgggttatctctgaatttgtaagagataattcacatgaggattaagataaaatgggaagtaaaatctaacaaacacaaagatagctcccaggcactgctttgtgtagtttgacagcattgtggttgtagcagcaaaggacttaaagtgatagtttttaaaccatattctgtccctaagtaataaaaaatctaggaagttactaaaataccagatttgttctgctctgcctcatctagaatcaacgtctaactaacttaaatgaagtataataaatgagttcatatgaaaaggcttcctctatggacacttagatatattgtaactattgaagttacctgggatgtgggggtggtgggaggaggacctgcctccccaggacatctatgactaaggcctggctttagttatggagagagacgtagaagttgaattttacacccaaaattgatgtgactgaagaggaactgattgttgctaaccagctcacaagaatccagtattgagaccagttcactagaagaaacaaacatttctgccatgcagaccaaaaagttattagttggtgaatatgtattttctctttggaaggtctttaaggggagcaaaccagttttaatcaatcagattgcttggtaagtttggaatctgcaatcagttggtcttaaaaaaaaaaaaactttattttggaaatttaaagacatacacaaaagaggaacaatataattaacctctgttaactcatcaccaacaagactcatgaccacttttatacttcatgagtgattgtatttgtatccactgttttctattattttcgagcaagtctcagacacaccatttaatctgtaaataattcagcatgtatctctaaaagacaaagacctcttaaataacagttcattagtataaaacaaattgggtaaacttttgttggtcatcaaactatattagcactggtccaatagtttaattttcattgagcctttcaagaggaccgaccagtctgctgctcaagacatcctctcctctggaatgtagagataatacatatcatgctcctttttgttaaaacgtttttttttccccttcaaacacagtccattcatttttcagtttgggttgaaacatccttttcttgatcttgagcttataataacctagtcatattgctcagctcagatatttttactccctctccttaggcattctggttccttaaatatagttagtgtcacagaggataaataaccaaccttatttctaaggtctgagaacacttggaccacatattggttgagctcagccaccttctgattaaagttttcagacttgtaagaactgaaaatttttatggtggaagttctctgagccctcatccattctgtttttaaaaatgcattgcagatgggctatgtgaatatgtttttaaacatctgatatgtgcatgaaacaaaaaacacttgaagttattatgtatacaattctgtgggatgggacttcatgcaggattggttttcaagtttgatttcctgagggattttttagttgtttgtgaaagaaccccaggtctacttttgaaattttgtattataattgtaatgttgcccatggttaaaaaaaaaaagtgttcagtgatctatgtctcctactactcctatttctctgtttttcctctgcaggagcttgctgctgttaacagttattcttccaagttgttttctttgtggggagatgggaggtgggaggaaatataaacatatatgtatagatctttcaaaatatatgacggtatacccgtatgttctgagtcttgctgtttttacctggtaatatttagaaacatttattttgagataaaggagagcacttttaagttgaacctgtagttttaaaaagtacatttcaagtaagccaaagcagagaagtaaatgtatttttcattgttgtatcagaattttgaatttactattttaaaaattcaagagttttgtagctgatctatttcttcccctcagccatcccaaataggtcatttgtcaacagatttaagaatgtttagaaacaacaactttgggaaacgggaaacaatttggtataagtgggtgtgccataacctctctcgtagccattcattcccggatacataccctagagaaactcttacacatgcgtaccaggggatggatttaagcatttgtgtgtaataggaagaaaagaagaaaaaacccgggaagatcccaagtgtccaccaacagtgtgttggataaatactgtggtatattccaacagtggaattccacagaagtgaaactgaactgcagctgtgtatgtgaacatggacaaaactcaacaatagaaggatcaaaaaaagcaagtcacagaagaatacatcactatggttccatttcaatgaaagtcaaaaacaggctgtcaaatacatgataaaaggaaacgattaagacaaaatttaatgttagccgttttgatggagggagaggtgatcatgagggcacaggggtcttcagaagaactggtgagggtctgtttctgaagcctgtgggcatttccttttttaatctgtatgtttatgtgcttttgtatgtatgatatttcttaataaaatttaaaaagaagaatggg

SEQ ID NO: 16514 - DNA, 838 bp, Homo sapiens
gtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaaaaaaaaaaaaaaaaaaaaaaa

SEQ ID NO: 16515 - DNA, 1597 bp, Homo sapiens
ggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttt

SEQ ID NO: 16516 - DNA, 3008 bp, Homo sapiens
gagcacattgcacttaattgttgccacagccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtgactgggctgggtctccccaccccccttcagctcttgtatcactcagaatctggcagccagttccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatcactgtgtttgacttcttgtgaaatttctgtactttgtatataaaatacataaaacaatagattagaaatcaaaagatatctctggcctgcaatattttactgatgtgaacataggattttccactaaataatttgtctacttctagcattcacttacaaagagttcttaaaaacacctataataggtacttagatttcacaacttacttagatatttgtcattattcccattcctggtgtttttactggttcatatacaatggtattctattagataagaagctgctatgtgatctcagcactcactccttggttgtcaagaaatggtggataactcacaggattaaaaatgaatgaatataaaattttctgaaatagatatttaaaaaatcattttagcttgaagccaatatgtctggatcataggttttgagttcataatccagtaataacagctttcagctttctatgagtatatacaattctatacaatgataaatactctgcatataatttataaaaataacttctgttttacctagttaacaataaaacctatgtgtggagccaaatgttatgcagacaaaggtctgctcatcccataccagtgtatatatagtcaaatatgtgtctagtacaaataaaatgtatctctaaggcataaaatgttttaacacaccacttttagtgaactctatcttatggtacagcggcctttcatcagaggatcatcattgagactgagttgactggcagatatgtgcgatggatattacattaggtacaatgtgtatttttgattttcatgagttttctacattaaggtaaattccttagagtgtgatagcagcctcagtttatttgttggtttaaacttgaaatctactttttctcgataaaactataatgtagatgaa

SEQ ID NO: 16517 - DNA, 2989 bp, Homo sapiens
gcagaagcccagttcgccggccatgaagcagcggttctcggcgctgcagctgctgaagctgctgctgctgctgcagccgccgctgccacgagcgctgcgcgaggcgctctgccctgagccctgcaactgcgtgcccgacggcgccctgcgctgccccggccccacggccggtctcactcgactatcacttgcctacctccctgtcaaagtgatcccatctcaagctttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttccccgattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttggatatttcttccaccaaattgcaggccctgccgagctatggcctagagtccattcagaggctaattgccacgtcatcctattctctaaaaaaattgccatcaagagaaacatttgtcaatctcctggaggccacgttgacttaccccagccactgctgtgcttttagaaacttgccaacaaaagaacagaatttttcacattccatttctgaaaacttttccaaacaatgtgaaagcacagtaaggaaagtgaataacaaaacactttattcttccatgcttgctgagagtgaactgagtggctgggactatgaatatggtttctgcttacccaagacaccccgatgtgctcctgaaccagatgcttttaatccctgtgaagatattatgggctatgacttccttagggtcctgatttggctgattaatattctagccatcatgggaaacatgactgttctttttgttctcctgacaagtcgttacaaacttacagtgcctcgttttctcatgtgcaatctctcctttgcagacttttgcatggggctctatctgctgctcatagcctcagttgattcccaaaccaagggccagtactataaccatgccatagactggcagacagggagtgggtgcagcactgctggctttttcactgtattcgcaagtgaactttctgtctacaccctcaccgtcatcactctagaaagatggcacaccatcacctatgctattcacctggaccaaaagctgcgattaagacatgccattctgattatgcttggaggatggctcttttcttctctaattgctatgttgccccttgtcggtgtcagcaattacatgaaggtcagtatttgcttccccatggatgtggaaaccactctctcacaagtctatatattaaccatcctgattctcaatgtggtggccttcttcataatttgtgcttgctacattaaaatttattttgcagttcgaaacccagaattaatggctaccaataaagatacaaagattgctaagaaaatggcaatcctcatcttcaccgatttcacctgcatggcacctatctctttttttgccatctcagctgccttcaaagtacctcttatcacagtaaccaactctaaagttttactggttcttttttatcccatcaattcttgtgccaatccatttctgtatgcaatattcactaagacattccaaagagatttctttcttttgctgagcaaatttggctgctgtaaacgtcgggctgaactttatagaaggaaagatttttcagcttacacctccaactgcaaaaatggcttcactggatcaaataagccttctcaatccaccttgaagttgtccacattgcactgtcaaggtacagctctcctagacaagactcgctacacagagtgttaactgttacatcagtaactgcattattgaattgttcttaaacctgtaaaaaaaaattacctgtaccagtaattttaacataaagggttggatttaggaaattatttatttttaggtacattaggcaagagacctctacctagtagaaagtgtagtctatgaccactgccacactaaaaactatttgtcattgttacatggcataaatactgaagttgagagtgtttagaaatttttatagaaattttgacacagtaattttgtttgatgaatcttttaaaaaactgaggaggtattttgcatatcttttttttcattttcgtaatttgtattgcattctataaaaatattagttcataacagatcagaaatttaaaataactggcctttttcctcaggtagtttgaaaaacacactctagagatgcactgtccaatccggtagccactagccacatgtggctaaattaaaattaaataaaatgagaaatgtagtttctcagttgcactagccacgtttcaagttctcaatggctacgtgtgactagtgcttaccatactggacagcacagacacagaatattttcatcaccacagaaagttctatctgttctattatagagacttttatctatgccctatctggattctacttatttataatttaaggtaaacatctgaaagcacatttcagcctatttgcttagtgaaacattaagctgtagactgtaaactcctcgtgagtaggaaccctgtctcagtgcattttgttttcctgcttcctacctcaagatcttggcaatggtacactacaaatgtgctgagttagaattactctgaagttatgaaacatataatgaaaacaattttt

SEQ ID NO: 16518 - DNA, 2899 bp, Homo sapiens
agaggggtgcgggccgcactcagaggccgtccaagacactggcaagccgcagaagcccagttcgccggccatgaagcagcggttctcggcgctgcagctgctgaagctgctgctgctgctgcagccgccgctgccacgagcgctgcgcgaggcgctctgccctgagccctgcaactgcgtgcccgacggcgccctgcgctgccccggccccacggccggtctcactcgactatcacttgcctacctccctgtcaaagtgatcccatctcaagctttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttccccgattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttacagaatttttcacattccatttctgaaaacttttccaaacaatgtgaaagcacagtaaggaaagtgaataacaaaacactttattcttccatgcttgctgagagtgaactgagtggctgggactatgaatatggtttctgcttacccaagacaccccgatgtgctcctgaaccagatgcttttaatccctgtgaagatattatgggctatgacttccttagggtcctgatttggctgattaatattctagccatcatgggaaacatgactgttctttttgttctcctgacaagtcgttacaaacttacagtgcctcgttttctcatgtgcaatctctcctttgcagacttttgcatggggctctatctgctgctcatagcctcagttgattcccaaaccaagggccagtactataaccatgccatagactggcagacagggagtgggtgcagcactgctggctttttcactgtattcgcaagtgaactttctgtctacaccctcaccgtcatcactctagaaagatggcacaccatcacctatgctattcacctggaccaaaagctgcgattaagacatgccattctgattatgcttggaggatggctcttttcttctctaattgctatgttgccccttgtcggtgtcagcaattacatgaaggtcagtatttgcttccccatggatgtggaaaccactctctcacaagtctatatattaaccatcctgattctcaatgtggtggccttcttcataatttgtgcttgctacattaaaatttattttgcagttcgaaacccagaattaatggctaccaataaagatacaaagattgctaagaaaatggcaatcctcatcttcaccgatttcacctgcatggcacctatctctttttttgccatctcagctgccttcaaagtacctcttatcacagtaaccaactctaaagttttactggttcttttttatcccatcaattcttgtgccaatccatttctgtatgcaatattcactaagacattccaaagagatttctttcttttgctgagcaaatttggctgctgtaaacgtcgggctgaactttatagaaggaaagatttttcagcttacacctccaactgcaaaaatggcttcactggatcaaataagccttctcaatccaccttgaagttgtccacattgcactgtcaaggtacagctctcctagacaagactcgctacacagagtgttaactgttacatcagtaactgcattattgaattgttcttaaacctgtaaaaaaaaattacctgtaccagtaattttaacataaagggttggatttaggaaattatttatttttaggtacattaggcaagagacctctacctagtagaaagtgtagtctatgaccactgccacactaaaaactatttgtcattgttacatggcataaatactgaagttgagagtgtttagaaatttttatagaaattttgacacagtaattttgtttgatgaatcttttaaaaaactgaggaggtattttgcatatcttttttttcattttcgtaatttgtattgcattctataaaaatattagttcataacagatcagaaatttaaaataactggcctttttcctcaggtagtttgaaaaacacactctagagatgcactgtccaatccggtagccactagccacatgtggctaaattaaaattaaataaaatgagaaatgtagtttctcagttgcactagccacgtttcaagttctcaatggctacgtgtgactagtgcttaccatactggacagcacagacacagaatattttcatcaccacagaaagttctatctgttctattatagagacttttatctatgccctatctggattctacttatttataatttaaggtaaacatctgaaagcacatttcagcctatttgcttagtgaaacattaagctgtagactgtaaactcctcgtgagtaggaaccctgtctcagtgcattttgttttcctgcttcctacctcaagatcttggcaatggtacactacaaatgtgctgagttagaattactctgaagttatgaaacatataatgaaaacaattttttctagagcttatatttttatttgaatgaaataaaatgtttaaatattt

SEQ ID NO: 16519 - DNA, 1477 bp, Homo sapiens
ggccgcactcagaggccgtccaagacactggcaagccgcagaagcccagttcgccggccatgaagcagcggttctcggcgctgcagctgctgaagctgctgctgctgctgcagccgccgctgccacgagcgctgcgcgaggcgctctgccctgagccctgcaactgcgtgcccgacggcgccctgcgctgccccggccccacggccggtctcactcgactatcacttgcctacctccctgtcaaagtgatcccatctcaagctttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttccccgattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttggatatttcttccaccaaattgcaggccctgccgagctatggcctagagtccattcagaggctaattgccacgtcatcctattctctaaaaaaattgccatcaagagaaacatttgtcaatctcctggaggccacgttgacttaccccagccactgctgtgcttttagaaacttgccaacaaaagaacagaatttttcacattccatttctgaaaacttttccaaacaatgtgaaagcacagtaaggaaagtgaataacaaaacactttcgaaacccagaattaatggctaccaataaagatacaaagattgctaagaaaatggcaatcctcatcttcaccgatttcacctgcatggcacctatctctttttttgccatctcagctgccttcaaagtacctcttatcacagtaaccaactctaaagttttactggttcttttttatcccatcaattcttgtgccaatccatttctgtatgcaatattcactaagacattccaaagagatttctttcttttgctgagcaaatttggctgctgtaaacgtcgggctgaactttatagaaggaaagatttttcagcttacacctccaactgcaaaaatggcttcactggatcaaataagccttctcaatccaccttgaagttgtccacattgcactgtcaaggtacagctctcctagacaagactcgctacacagagtgttaactgttacatcagtaactgcattattgaa

SEQ ID NO: 16520 - DNA, 1921 bp, Homo sapiens
ggccgcactcagaggccgtccaagacactggcaagccgcagaagcccagttcgccggccatgaagcagcggttctcggcgctgcagctgctgaagctgctgctgctgctgcagccgccgctgccacgagcgctgcgcgaggcgctctgccctgagccctgcaactgcgtgcccgacggcgccctgcgctgccccggccccacggccggtctcactcgactatcacttgcctacctccctgtcaaagtgatcccatctcaagctttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttccccgattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttggatatttcttccaccaaattgcaggccctgccgagctatggcctagagtccattcagaggctaattgccacgtcatcctattctctaaaaaaattgccatcaagagaaacatttgtcaatctcctggaggccacgttgacttaccccagccactgctgtgcttttagaaacttgccaacaaaagaacagaatttttcacattccatttctgaaaacttttccaaacaatgtgaaagcacagtaaggaaagtgaataacaaaacactacttttgcatggggctctatctgctgctcatagcctcagttgattcccaaaccaagggccagtactataaccatgccatagactggcagacagggagtgggtgcagcactgctggctttttcactgtattcgcaagtgaactttctgtctacaccctcaccgtcatcactctagaaagatggcacaccatcacctatgctattcacctggaccaaaagctgcgattaagacatgccattctgattatgcttggaggatggctcttttcttctctaattgctatgttgccccttgtcggtgtcagcaattacatgaaggtcagtatttgcttccccatggatgtggaaaccactctctcacaagtctatatattaaccatcctgattctcaatgtggtggccttcttcataatttgtgcttgctacattaaaatttattttgcagttcgaaacccagaattaatggctaccaataaagatacaaagattgctaagaaaatggcaatcctcatcttcaccgatttcacctgcatggcacctatctctttttttgccatctcagctgccttcaaagtacctcttatcacagtaaccaactctaaagttttactggttcttttttatcccatcaattcttgtgccaatccatttctgtatgcaatattcactaagacattccaaagagatttctttcttttgctgagcaaatttggctgctgtaaacgtcgggctgaactttatagaaggaaagatttttcagcttacacctccaactgcaaaaatggcttcactggatcaaataagccttctcaatccaccttgaagttgtccacattgcactgtcaaggtacagctctcctagacaagactcgctacacagagtgttaactgttacatcagtaactgcattattgaa

SEQ ID NO: 16521 - DNA, 2073 bp, Homo sapiens
atgaagcagcggttctcggcgctgcagctgctgaagctgctgctgctgctgcagccgccgctgccacgagcgctgcgcgaggcgctctgccctgagccctgcaactgcgtgcccgacggcgccctgcgctgccccggccccacggccggtctcactcgactatcacttgcctacctccctgtcaaagtgatcccatctcaagctttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttccccgattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttggatatttcttccaccaaattgcaggccctgccgagctatggcctagagtccattcagaggctaattgccacgtcatcctattctctaaaaaaattgccatcaagagaaacatttgtcaatctcctggaggccacgttgacttaccccagccactgctgtgcttttagaaacttgccaacaaaagattattcttccatgcttgctgagagtgaactgagtggctgggactatgaatatggtttctgcttacccaagacaccccgatgtgctcctgaaccagatgcttttaatccctgtgaagatattatgggctatgacttccttagggtcctgatttggctgattaatattctagccatcatgggaaacatgactgttctttttgttctcctgacaagtcgttacaaacttacagtgcctcgttttctcatgtgcaatctctcctttgcagacttttgcatggggctctatctgctgctcatagcctcagttgattcccaaaccaagggccagtactataaccatgccatagactggcagacagggagtgggtgcagcactgctggctttttcactgtattcgcaagtgaactttctgtctacaccctcaccgtcatcactctagaaagatggcacaccatcacctatgctattcacctggaccaaaagctgcgattaagacatgccattctgattatgcttggaggatggctcttttcttctctaattgctatgttgccccttgtcggtgtcagcaattacatgaaggtcagtatttgcttccccatggatgtggaaaccactctctcacaagtctatatattaaccatcctgattctcaatgtggtggccttcttcataatttgtgcttgctacattaaaatttattttgcagttcgaaacccagaattaatggctaccaataaagatacaaagattgctaagaaaatggcaatcctcatcttcaccgatttcacctgcatggcacctatctctttttttgccatctcagctgccttcaaagtacctcttatcacagtaaccaactctaaagttttactggttcttttttatcccatcaattcttgtgccaatccatttctgtatgcaatattcactaagacattccaaagagatttctttcttttgctgagcaaatttggctgctgtaaacgtcgggctgaactttatagaaggaaagatttttcagcttacacctccaactgcaaaaatggcttcactggatcaaataagccttctcaatccaccttgaagttgtccacattgcactgtcaaggtacagctctcctagacaagactcgctacacagagtgttaactgttacatcagtaactgcattattgaattgttcttaaacctgtaaaaaaaaat

SEQ ID NO: 16522 - DNA, 1291 bp, Homo sapiens
tttagggtagaagaaaaggttttatttttctttctcacattggaaaaaatgaaaactttcggacccatgaaattttattacattttgccaaaaacagaaccaataacataagtattcaaagttatgtaaagataattatttaatatgaacattatgatggtgagagggaccacggagcaaggggctgccttgcaggcctgccttccagctttgctacagggaccagaagcgggagctgagcgcaggggaggcaggcggaggccatgggcagcgaggcgggtgcgccaaagggcgccagttccggagctgctgggcctgggctgcaggagggcggagctggggccgcaaggctggtgccggccgacaaacgacgcggcgcgggcgagtgggcggaggcggctgcggggaaggctgggctgccgcgggacgcggtgaagatagcctgcggagtgtccgggctgaacacggttgcagcactcccagtagaccaggagctccgggaggcagggccggccccacgtcctctgcgcaccaccctgagttggatcctctgtgcgccacctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctctgcagccgaagccatatggtgtcaccagtgcacgggcttcggagggtgctcccatggatccagatgcctgagggactccacccactgtgtcaccactgccacccgggtcctcagcaacaccgaggatttgcctctggtcaccaagatgtgccacataggctgccccgatatccccagcctgggcctgggcccctacgtatccatcgcttgctgccagaccagcctctgcaaccatgactgacggctgccctcctccaggcccccggacgctcagcccccacagcccccacagcctggcgccagggctcacagctgcccctccctcgagactggccagcccacctctcccggcctctgcagccaccgtccagcaccgcttgtcctagggaagtcctgcgtggagtcttgcctcaatctgctgccgtccaagcctggggcccatcgtgcctgccgccccttcaggtcccgacctccccacaataaaatgtgattggatcgtgtggtacaa

SEQ ID NO: 16523 - DNA, 866 bp, Homo sapiens
gagggggttgggaagctcgaagccgcaggcctgactctggcctttggcatcctggggttggcctgggcaaatgtgtcgtgagagacggatttgttgttctcgggaaggcggttgcagcactcccagtagaccaggagctccgggaggcagggccggccccacgtcctctgcgcaccaccctgagttggatcctctgtgcgccacctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaaggtcagtaagtcctgcgtgccccgctgcttcgagactgtgtatgatggctactccaagcacgcgtccaccacctcctgctgccagtacgacctctgcaacggcaccggccttgccaccccggccaccctggccctggcccccatcctcctggccaccctctggggtctcctctaaagcccccgaggcagacccactcaagaacaaagctctcgagacacactgctacaccctcgcacccagctcaccctgcctcaccctccacactccctgcgacctcctcagccatgcccagggtcaggactgtgggcaagaagacacccgacctcccccaaccaccacacgacctcacttcgaggccttgacctttcgatgctgtgtgggatcccaaaagtgtccggctttgatgggctgatcagcc

SEQ ID NO: 16524 - DNA, 4535 bp, Homo sapiens
ggctgccgcgggacgcggtgaagatagcctgcggagtgtccgggctgaacacggttgcagcactcccagtagaccaggagctccgggaggcagggccggccccacgtcctctgcgcaccaccctgagttggatcctctgtgcgccacctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaaggtcagtaagtcctgcgtgccccgctgcttcgagactgtgtatgatggctactccaagcacgcgtccaccacctcctgctgccagtacgacctctgcaacggcaccggccttgccaccccggccaccctggccctggcccccatcctcctggccaccctctggggtctcctctaaagcccccgaggcagacccactcaagaacaaagctctcgagacacactgctacaccctcgcacccagctcaccctgcctcaccctccacactccctgcgacctcctcagccatgcccagggtcaggactgtgggcaagaagacacccgacctcccccaaccaccacacgacctcacttcgaggccttgacctttcgatgctgtgtgggatcccaaaagtgtccggctttgatgggctgatcagcccctcgcctgtccagggctatttatggggaggggcccagtcaggcagggagcactgagcagatgggagctgtggccaagcccaccttctgggaagccctaggagaggcccctgcctcagtctgcccctggtgtgctggggcagggggaagacaaggaatgcccgcaggtggggtggtggggagactcttaggaggaaaggctcctccaggcctagtcacgcttcctactgaggccaggagctgccaggaccggtacgggatcagggctgtgggaggagggcctttggcaccggcccctgtgctaggaagtctgccaggcccgagttggagccaccccctgcaggggagggggcggctctgcctcagcaggccccagggcccccgaagtcacagaagctttttcgggtccagcaaggggtgtgtgtcctctcagtcaaaccccttgacgtttcccaccccctcacggggagggcaccaggcctgaagctggcaggagctagggccatgctatatttggtgggtcctggacgctgacccggccagcgctattctgggcagggagggaaaggggcagagcaggtggtcccccgagtcctggtccccaaccacagcaggacccagccgagcaaggcaaaagacgcaggactgggggatgcgcgcacaggctgggggttgggagcagcctggggccggcgcgggcctgggcgtgggaaggcggagcatgccaccctctcgtggccgtgcgggggcgggagtggggagggtggggtggggagggcggagacccagcccctcccccgcagcgggatgcgcacagtgagtgggtccctccatcaccttccacctggggatgcacccactgggagggcagggtggaagccccagctgggtgtgtggactcccagggaccccaccccaggcctgggaagcaggggtcagcccaacacgcaccaatccatccccgatgcaggtagcccagggagcacctgcccctgctgtgaatggggcattcgggggcgtgagaccttttggtgccagcggtcacgctgcacctgaggcccccacctgaccagtgctcccagctctggtgtcctgagaaacccttcaagccatcccgcatgggcaggatggtgacatatccatgtggtaggattgtcccggccccaaagtatggccctggtcaggggagcccctgctggaaattgcatctccagagctttgatgcaggacccctgggggatcagggaatgagggtctccaccccaggggtctccttgcagtgagtctatatgcaggcctgcgttctgctcctggggctggttctgagtgcccagcttcagtctcctgagaacatgaggatgggagggggcagagtcttgctgagggcacacccagttcccgctggaggaggacagtgccagtcttctgcaaagggaccttgggtgggaacgggcccggagcgggaggaacgtgactccccagagggaagatgggcatcatactgggcccagagctgggaaggagttgctgccagcacagggtgggcctggactcccctcgcccctacccccagtggttgtggctgtagccctaagcctggagagcaggaccggcccggggtgtctgggaggctgccaggtgcctcccagagctcccaagggcccccacctgcaagtgccagcctcagggcagtgcccaaatgaggccctctcagctgcagccagcgatgccttgggatgcttaccgggagggaggcggctttgggctcctaagtccttgggagaggctgggagcagtcactgcgcggcttgcgcaagcccattgtcgggttgggtggcttcctcagccagggctgggagggactccaggatcaggtcctccctgtctcgagtctcagtggggtgatggggaggagacctggccacccatggctcaggggcagctgagaacaaggacctgctggagctggaagtgctgtggtgttgaggggtggggtgggcagcttctcacacctgcctcctgcctccttctgtccacctttccaccaccctgacctgtcccagccccacacatggttctgcctggctggcctgcccttggcacctggcgtagagcacacagaaggcactcagctaatgctgggcaggcccactcatggggagtgcgtggctgtgcagcaccagggaaccggcacagcagcgccggcagaaatcacagcagtaaacttgtccgggttgtatgcatcaaggtggcgatggacgtgggtccccccactgcactgtggccctgagcactgtatagcagcccggcaatgggagccattatcttgcccctttgacagaggaggacacagaggcacagggaggtgaagtagctgccccacactagtgcctcctcgctcactcaccaccccctgcaccacagtgcagccgcttctcccaccagctggggttccttggacccccaagcctgggaagggggaggtgagtttacaaaatggaaagcttaaaaggagaaaagtggaaccagaggtttgagaagccctgagtggtagagtaaggcctccagcgctgcctctgggtgcagggcagagtggcagaggagagggggagaggcactgggcaccatgggggcccagttcccacttcggggatctctctcgcagaaccgagggtccccttcatgggggtagatgcccagggctagctgttgccactgtctgtgtggacctgagtcctggacatgcccgagtgactcaggagtggctgcttgggcgggctctgtcaccctaggatgttatacattctgggaactggacaggagtggctgcttgggcgggctctggcaccctgggatgttatacattctgggaactggacaggagtggctgcttgggtgggctctggcaccctgggatgttatacattctgggaactgcaatcagccactagagaagtcggagctacaggaagtgaccctggggtgggacctggggacatggccaggtcagcatggggacacccggctccagcaggagctctggtctgtcctggggtctttgggggcagggctgcggccctgggcaggcttcctccaggcggaggtcctggggaagtgggggagccaggccagctgccgcctcccccactatgtagcatctgattcgtcatctctcatgaaggcgatttggttcataactctgaaactctgaaaaaggtcaaaagaagcagagaggccctcggtggatatgccagcttttctgccggtgctttctcccactactctgggtggtctgctctcctcttcaaacctcagctcgcagggagggcctgaatctgccagcccctcaggatctccttccctctgggccctccccagccttaaggagcctcccagacagaagggtggacagagccacctgggcagcccgagagacacacgggggtcctccctgtggacagccctgccagcttccgcccagccctgagcttcatttgcatcttgaggagtaaggggtggtgaaatgggaatgctggtctggctcagctggtcgtgggcataagtgcccgctgaatggatggcatctctccctcctgtcttatgttctggggtccaggtgcttcccagggccatgcccctgctgctaatgcttgccctaacccttaccctaaccagcgtccagcgtcgtctcaccgagccgtaaataaatcaacagattcgcattgtc

SEQ ID NO: 16525 - DNA, 4706 bp, Homo sapiens
ggggccggggcaggcctggggcggggcctgcggtgagctcgcgctgggcgggctgttccgggggcgggactgggctgggcctgcggtgagcatcaggcgatgcggcacgggtgctgcgggacacacagacacgcctacgattagactcaggcaggcacctaccggcgagcggccgcgggtgactcccaggcgcggcggtacctcacggtggtgaaggtcacagggttgcagcactcccagtagaccaggagctccgggaggcagggccggccccacgtcctctgcgcaccaccctgagttggatcctctgtgcgccacctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaaggtcagtaagtcctgcgtgccccgctgcttcgagactgtgtatgatggctactccaagcacgcgtccaccacctcctgctgccagtacgacctctgcaacggcaccggccttgccaccccggccaccctggccctggcccccatcctcctggccaccctctggggtctcctctaaagcccccgaggcagacccactcaagaacaaagctctcgagacacactgctacaccctcgcacccagctcaccctgcctcaccctccacactccctgcgacctcctcagccatgcccagggtcaggactgtgggcaagaagacacccgacctcccccaaccaccacacgacctcacttcgaggccttgacctttcgatgctgtgtgggatcccaaaagtgtccggctttgatgggctgatcagcccctcgcctgtccagggctatttatggggaggggcccagtcaggcagggagcactgagcagatgggagctgtggccaagcccaccttctgggaagccctaggagaggcccctgcctcagtctgcccctggtgtgctggggcagggggaagacaaggaatgcccgcaggtggggtggtggggagactcttaggaggaaaggctcctccaggcctagtcacgcttcctactgaggccaggagctgccaggaccggtacgggatcagggctgtgggaggagggcctttggcaccggcccctgtgctaggaagtctgccaggcccgagttggagccaccccctgcaggggagggggcggctctgcctcagcaggccccagggcccccgaagtcacagaagctttttcgggtccagcaaggggtgtgtgtcctctcagtcaaaccccttgacgtttcccaccccctcacggggagggcaccaggcctgaagctggcaggagctagggccatgctatatttggtgggtcctggacgctgacccggccagcgctattctgggcagggagggaaaggggcagagcaggtggtcccccgagtcctggtccccaaccacagcaggacccagccgagcaaggcaaaagacgcaggactgggggatgcgcgcacaggctgggggttgggagcagcctggggccggcgcgggcctgggcgtgggaaggcggagcatgccaccctctcgtggccgtgcgggggcgggagtggggagggtggggtggggagggcggagacccagcccctcccccgcagcgggatgcgcacagtgagtgggtccctccatcaccttccacctggggatgcacccactgggagggcagggtggaagccccagctgggtgtgtggactcccagggaccccaccccaggcctgggaagcaggggtcagcccaacacgcaccaatccatccccgatgcaggtagcccagggagcacctgcccctgctgtgaatggggcattcgggggcgtgagaccttttggtgccagcggtcacgctgcacctgaggcccccacctgaccagtgctcccagctctggtgtcctgagaaacccttcaagccatcccgcatgggcaggatggtgacatatccatgtggtaggattgtcccggccccaaagtatggccctggtcaggggagcccctgctggaaattgcatctccagagctttgatgcaggacccctgggggatcagggaatgagggtctccaccccaggggtctccttgcagtgagtctatatgcaggcctgcgttctgctcctggggctggttctgagtgcccagcttcagtctcctgagaacatgaggatgggagggggcagagtcttgctgagggcacacccagttcccgctggaggaggacagtgccagtcttctgcaaagggaccttgggtgggaacgggcccggagcgggaggaacgtgactccccagagggaagatgggcatcatactgggcccagagctgggaaggagttgctgccagcacagggtgggcctggactcccctcgcccctacccccagtggttgtggctgtagccctaagcctggagagcaggaccggcccggggtgtctgggaggctgccaggtgcctcccagagctcccaagggcccccacctgcaagtgccagcctcagggcagtgcccaaatgaggccctctcagctgcagccagcgatgccttgggatgcttaccgggagggaggcggctttgggctcctaagtccttgggagaggctgggagcagtcactgcgcggcttgcgcaagcccattgtcgggttgggtggcttcctcagccagggctgggagggactccaggatcaggtcctccctgtctcgagtctcagtggggtgatggggaggagacctggccacccatggctcaggggcagctgagaacaaggacctgctggagctggaagtgctgtggtgttgaggggtggggtgggcagcttctcacacctgcctcctgcctccttctgtccacctttccaccaccctgacctgtcccagccccacacatggttctgcctggctggcctgcccttggcacctggcgtagagcacacagaaggcactcagctaatgctgggcaggcccactcatggggagtgcgtggctgtgcagcaccagggaaccggcacagcagcgccggcagaaatcacagcagtaaacttgtccgggttgtatgcatcaaggtggcgatggacgtgggtccccccactgcactgtggccctgagcactgtatagcagcccggcaatgggagccattatcttgcccctttgacagaggaggacacagaggcacagggaggtgaagtagctgccccacactagtgcctcctcgctcactcaccaccccctgcaccacagtgcagccgcttctcccaccagctggggttccttggacccccaagcctgggaagggggaggtgagtttacaaaatggaaagcttaaaaggagaaaagtggaaccagaggtttgagaagccctgagtggtagagtaaggcctccagcgctgcctctgggtgcagggcagagtggcagaggagagggggagaggcactgggcaccatgggggcccagttcccacttcggggatctctctcgcagaaccgagggtccccttcatgggggtagatgcccagggctagctgttgccactgtctgtgtggacctgagtcctggacatgcccgagtgactcaggagtggctgcttgggcgggctctgtcaccctaggatgttatacattctgggaactggacaggagtggctgcttgggcgggctctggcaccctgggatgttatacattctgggaactggacaggagtggctgcttgggtgggctctggcaccctgggatgttatacattctgggaactgcaatcagccactagagaagtcggagctacaggaagtgaccctggggtgggacctggggacatggccaggtcagcatggggacacccggctccagcaggagctctggtctgtcctggggtctttgggggcagggctgcggccctgggcaggcttcctccaggcggaggtcctggggaagtgggggagccaggccagctgccgcctcccccactatgtagcatctgattcgtcatctctcatgaaggcgatttggttcataactctgaaactctgaaaaaggtcaaaagaagcagagaggccctcggtggatatgccagcttttctgccggtgctttctcccactactctgggtggtctgctctcctcttcaaacctcagctcgcagggagggcctgaatctgccagcccctcaggatctccttccctctgggccctccccagccttaaggagcctcccagacagaagggtggacagagccacctgggcagcccgagagacacacgggggtcctccctgtggacagccctgccagcttccgcccagccctgagcttcatttgcatcttgaggagtaaggggtggtgaaatgggaatgctggtctggctcagctggtcgtgggcataagtgcccgctgaatggatggcatctctccctcctgtcttatgttctggggtccaggtgcttcccagggccatgcccctgctgctaatgcttgccctaacccttaccctaaccagcgtccagcgtcgtctcaccgagccgtaaataaatcaacagattcgcattgtc

SEQ ID NO: 16526 - DNA, 561 bp, Homo sapiens
gacaccccaggagcagagaggaggggaacagcgagaagagacccagcttttgggcccagtcctgccatggccagccatccggcccccagggccctgcttgggatggggctgcagaccacctcccatgggacctctgcaccaaccatcccctggggttgcagcactcccagtagaccaggagctccgggaggcagggccggccccacgtcctctgcgcaccaccctgagttggatcctctgtgcgccacctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaaggtcagtaagtcctgcgtgccccgctgcttcgagactgtgtatgatggctactccaagcacgcgtccacc

SEQ ID NO: 16527 - DNA, 637 bp, Homo sapiens
ggggccggggcaggcctggggcggggcctgcggtgagctcgcgctgggcgggctgttccgggggcgggactgggctgggcctgcggtgagcatcaggcgatgcggcacgggtgctgcgggacacacagacacgcctacgattagactcaggcaggcacctaccggcgagcggccgcgggtgactcccaggcgcggcggtacctcacggtggtgaaggtcacagggttgcagcactcccagtagaccaggagctccgggaggcagggccggccccacgtcctctgcgcaccaccctgagttggatcctctgtgcgccacctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaaggtcagtaagtcctgcgtgccccgctgcttcgagactgtgtatgatggctactccaagcacgcgtccaccacctcc

SEQ ID NO: 16528 - DNA, 1706 bp, Homo sapiens
aaggctggggttgcctggggcgaggttactcatcctgggctcaggtaagagggcccgagctcggaggcggcacatccaggggggacgccaagggagcaggacggagccatggaccccgccaggaaagcaggtgcccaggccatgatctggactgcaggctggctgctgctgctgctgcttcgcggaggagcgcaggccctggagtgctacagctgcgtgcagaaagcagatgacggatgctccccgaacaagatgaagacagtgaagtgcgcgccgggcgtggacgtctgcaccgaggccgtgggggcggtggagaccatccacggacaattctcgctggcagtgcggggttgcggttcgggactccccggcaagaatgaccgcggcctggatcttcacgggcttctggcgttcatccagctgcagcaatgcgctcaggatcgctgcaacgccaagctcaacctcacctcgcgggcgctcgacccggcaggtaatgagagtgcatacccgcccaacggcgtggagtgctacagctgtgtgggcctgagccgggaggcgtgccagggtacatcgccgccggtcgtgagctgctacaacgccagcgatcatgtctacaagggctgcttcgacggcaacgtcaccttgacggcagctaatgtgactgtgtccttgcctgtccggggctgtgtccaggatgaattctgcactcgggatggagtaacaggcccagggttcacgctcagtggctcctgttgccaggggtcccgctgtaactctgacctccgcaacaagacctacttctcccctcgaatcccaccccttgtccggctgccccctccagagcccacgactgtggcctcaaccacatctgtcaccacttctacctcggccccagtgagacccacatccaccaccaaacccatgccagcgccaaccagtcagactccgagacagggagtagaacacgaggcctcccgggatgaggagcccaggttgactggaggcgccgctggccaccaggaccgcagcaattcagggcagtatcctgcaaaaggggggccccagcagccccataataaaggctgtgtggctcccacagctggattggcagcccttctgttggccgtggctgctggtgtcctactgtgagcttctccacctggaaatttccctctcacctacttctctggccctgggtacccctcttctcatcacttcctgttcccaccactggactgggctggcccagcccctgtttttccaacattccccagtatccccagcttctgctgcgctggtttgcggctttgggaaataaaataccgttgtatatattctgccaggggtgttctagctttttgaggacagctcctgtatccttctcatccttgtctctccgcttgtcctcttgtgatgttaggacagagtgagagaagtcagctgtcacggggaaggtgagagagaggatgctaagcttcctactcactttctcctagccagcctggactttggagcgtggggtgggtgggacaatggctccccactctaagcactgcctcccctactccccgcatctttggggaatcggttccccatatgtcttccttactagactgtgagctcctcgagggcagggaccgtgccttatgtctgtgtgtgatcagtttctggcacataaatgcctcaataaagatttaattactttg

SEQ ID NO: 16529 - DNA, 907 bp, Homo sapiens
gccaagggagcaggacggagccatggaccccgccaggaaagcaggtgcccaggccatgatctggactgcaggctggctgctgctgctgctgcttcgcggaggagcgcaggccctggagtgctacagctgcgtgcagaaagcagatgacggatgctccccgaacaagatgaagacagtgaagtgcgcgccgggcgtggacgtctgcaccgaggccgtgggggcggtggagaccatccacggacaattctcgctggcagtgcggggttgcggttcgggactccccggcaagaatgaccgcggcctggatcttcacgggcttctggcgttcatccagctgcagcaatgcgctcaggatcgctgcaacgccaagctcaacctcacctcgcgggcgctcgacccggcagctgcagctaatgtgactgtgtccttgcctgtccggggctgtgtccaggatgaattctgcactcgggatggagtaacaggcccagggttcacgctcagtggctcctgttgccaggggtcccgctgtaactctgacctccgcaacaagacctacttctcccctcgaatcccaccccttgtccggctgccccctccagagcccacgactgtggcctcaaccacatctgtcaccacttctacctcggccccagtgagacccacatccaccaccaaacccatgccagcgccaaccagtcagactccgagacagggagtagaacacgaggcctcccgggatgaggagcccaggttgactggaggcgccgctggccaccaggaccgcagcaattcagggcagtatcctgcaaaaggggggccccagcagccccataataaaggctgtgtggctcccacagctggattggcagcccttctgttggccgtggctgctggtgtcctactgtga

SEQ ID NO: 16530 - DNA, 4071 bp, Homo sapiens
gagtggcgcgcgcgcccctagccgccccccgcctctccccgctgcgctccctcgctccttccctgagctcccgggctccggcagcgggctggcggggcgccgcattgcacactctgggggcgccgcagtgttcgtgggatggggcagcgggctgcagctggcggccggaatccgcgcgcagcccgggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgagagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttgttttcattccaagaagtagttctgcatttatcgagatctggggttcttaatttggaagaatacatgcatgagatgcagtaggtcctgagactgtaagatattaggagtatgttataggggcatgtatagatgtgggcttttcaggagaaaagtaaccattggtttaaatataatcatgagttcatttgtagctttagaattttaaaacattgactccaaactgaatggactatttccttggaaattctgactgagtccctggaagagtagtaattccaacaattccagccatttgttcaattaattttcccaacattcttctcccagtgctgggaatcacatttcctctgttctgtgcagaagacaaaaaggcaatcataaaagtttgttatatttgtgggggtgcctggaggaggattttcctcaacttaatggagccactgtccataaagtggctgttatcccttcatataattggtgagatcagccttctccttgacttggcacctaattatgcttcatgagatcctagattccacctgagtcaattgtgtccagagccccaaaccaggatggagttgttttccccagatatggggttctattcagccatagataatctagacagaggatttcagaatgaaaggaaaaatgtgtggagattagtcctagttcattctgagggccgactaagtggctcagccagcttcttactccatctgcagttcatactgccaaagagctcccacttccaaatccccagtgactttatggagaagattctgcattaaattgtctttcgaatgatggggaagcaaggcataatatgcgatgatgaggagaaagtagaccagtgaggtgattgcaagactaacaaggagactcaatgggaagtttttctttcttttagatattgcttttgaagtagatggtaaaatttttgtcatccttcttgtattttttgtaccccaagttacaatttttcttcttccttgtaaataatttaaacagtatttatttttgtaaggcataactagaaactaaaatatattctaaaaaattcattattctgaacaaagtgatcaaattagaatacatatttttcaacagtggtagagcttttaatatatgtttattgaaagttatctataatacttgcaccagtgttgaaaaaagttaacatgtaggcaagagcaatatgtttgtctcaaggatttttccatggtttcctcagtgatggtgtcctggaattattcaggtggtgaccatcactggtctaagtttgtgtgcagggttttcagatgtgtttttgtgaaacttggtagaaccatggctaataaagaggacagtgttgtcagggtccatctgccctccatagaaaaatgtctctggctcataaaatgagactccctcagggactaaatatgaactgacagcagtaactctgatacagaataatctaaattgcatcaaatggccttaattcagagtttgttaggcttatcagtatgttgcttttaattggggtgggaaagtagagggagagaaagcaagacatttattaagcacctcgtatgtgccaggcactatgctaagcactttacataagttaggattaatccctgcaagaatcctataaagaatgttactagcatttacacttcccaaatgaaggtaccaaagctcaaacgcaatgttgtgaagctgtttccttcagatttaggttatgtgggatgatgtgggattgaagaggaaagaaaggtgggattatccccctaggaagactttcaggcctgacttcataggaattcatccatcttatcatgtggagtttatctcaccctgctgttgcaggatgctatttgcatgtgtccccaggtgatgttttttctttggggagtaggggtttggcttcctcattcatccctcttgctaaaagaggagatagttgatgttgcatctaaagatgctataagacaatgaaagtttgatgttgtacatacctacaagtaccatttttgtgcatgattacactccactgacatcttccaagtactgcatgtgattgaataagaaacaagaaagtgaccacaccaaagcctccctggctggtgtagagggatcaggtccacagtggtgcagattcaaccaccacccagggagtgcttgcagactctgcatagatgttgctgcatgtgtcccatgtgcctgtcagaatggcagtgtttaattctcttgaaagaaagttatttgctcactatccccagcctcaaggagccaaggaagagtcattcacatggaaggtccgggactggtcagccactctgacttttctaccacattaaattctccattacatctcaatattggtaatggcttaagtgtaaagagccatgatgtgtatattaagctatgtgccacatatttatttttagactctccacagcattcatgtcaatatgggattaatgcctaaactttgtaaatattgtacagtttgtaaatcaatgaataaaggttttgagtgtatcttaccaggctcctccctgcaaatgcacatgtcaatcaatgattaatgcacccaggttatgtacaaggcactgggcttagcaccacagggaacttccttccagaggcttgctttctagttgtgtagacaagaatacatgcatgagaagatacaagacaattcacccatgccaaatgattcatacaggctgtttaagtactgcagaaaataaaagaaggaaaggctaccagacttttcaataaggtctacagcttcccaagagcatgtctttgttaaatcaggaaatataaaaattatgtgtgtatgtgtatgtatatatatataccaccctattaactattttaaaatcgtattctattttgggggttgtgttaatgatgatgaaccagaaaagattttctcttgatggtttcttcaacaggaaacagatattggaatagtgtacatgtcatttttatctatacaatgaatttattatatttttcttagtaaagtgatagacattgaaagcaagcttgaaaaa

SEQ ID NO: 16531 - DNA, 3578 bp, Homo sapiens
actgcaaacgtcaagtggtctccgccttccctgggttcggagcttcacttgctcttgagctctgcggtccggcggatttcgcggggcccaggggatggcggggagtgagatttggccagggtcatttcacactgccgggcctgcagccacgcacgcagctgctggcccggctgaggctggcggctagggagaggcgccagggggtcgcgcacaggaaggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgagagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttgttttcattccaagaagtagttctgcatttatcgagatctggggttcttaatttggaagaatacatgcatgagatgcagtaggtcctgagactgtaagatattaggagtatgttataggggcatgtatagatgtgggcttttcaggagaaaagtaaccattggtttaaatataatcatgagttcatttgtagctttagaattttaaaacattgactccaaactgaatggactatttccttggaaattctgactgagtccctggaagagtagtaattccaacaattccagccatttgttcaattaattttcccaacattcttctcccagtgctgggaatcacatttcctctgttctgtgcagaagacaaaaaggcaatcataaaagtttgttatatttgtgggggtgcctggaggaggattttcctcaacttaatggagccactgtccataaagtggctgttatcccttcatataattggtgagatcagccttctccttgacttggcacctaattatgcttcatgagatcctagattccacctgagtcaattgtgtccagagccccaaaccaggatggagttgttttccccagatatggggttctattcagccatagataatctagacagaggatttcagaatgaaaggaaaaatgtgtggagattagtcctagttcattctgagggccgactaagtggctcagccagcttcttactccatctgcagttcatactgccaaagagctcccacttccaaatccccagtgactttatggagaagattctgcattaaattgtctttcgaatgatggggaagcaaggcataatatgcgatgatgaggagaaagtagaccagtgaggtgattgcaagactaacaaggagactcaatgggaagtttttctttcttttagatattgcttttgaagtagatggtaaaatttttgtcatccttcttgtattttttgtaccccaagttacaatttttcttcttccttgtaaataatttaaacagtatttatttttgtaaggcataactagaaactaaaatatattctaaaaaattcattattctgaacaaagtgatcaaattagaatacatatttttcaacagtggtagagcttttaatatatgtttattgaaagttatctataatacttgcaccagtgttgaaaaaagttaacatgtaggcaagagcaatatgtttgtctcaaggatttttccatggtttcctcagtgatggtgtcctggaattattcaggtggtgaccatcactggtctaagtttgtgtgcagggttttcagatgtgtttttgtgaaacttggtagaaccatggctaataaagaggacagtgttgtcagggtccatctgccctccatagaaaaatgtctctggctcataaaatgagactccctcagggactaaatatgaactgacagcagtaactctgatacagaataatctaaattgcatcaaatggccttaattcagagtttgttaggcttatcagtatgttgcttttaattggggtgggaaagtagagggagagaaagcaagacatttattaagcacctcgtatgtgccaggcactatgctaagcactttacataagttaggattaatccctgcaagaatcctataaagaatgttactagcatttacacttcccaaatgaaggtaccaaagctcaaacgcaatgttgtgaagctgtttccttcagatttaggttatgtgggatgatgtgggattgaagaggaaagaaaggtgggattatccccctaggaagactttcaggcctgacttcataggaattcatccatcttatcatgtggagtttatctcaccctgctgttgcaggatgctatttgcatgtgtccccaggtgatgttttttctttggggagtaggggtttggcttcctcattcatccctcttgctaaaagaggagatagttgatgttgcatctaaagatgctataagacaatgaaagtttgatgttgtacatacctacaagtaccatttttgtgcatgattacactccactgacatcttccaagtactgcatgtgattgaataagaaacaagaaagtgaccacaccaaagcctccctggctggtgtagagggatcaggtccacagtggtgcagattcaaccaccacccagggagtgcttgcagactctgcatagatgttgctgcatgtgtcccatgtgcctgtcagaatggcagtgtttaattctcttgaaagaaagttatttgctcactatccccagcctcaaggagccaaggaagagtcattcacatggaaggtccgggactggtcagccactctgacttttctaccacattaaattctccattacatctcaatattggtaatggcttaagtgtaaagagccatgatgtgtatattaagctatgtgccacatatttatttttagactctccacagcattcatgtcaatatgggattaatgcctaaactttgtaaatattgtacagtttgtaaatcaatgaataaaggttttgagtgt

SEQ ID NO: 16532 - DNA, 565 bp, Homo sapiens
agcactgtgcagggcatgaaagaccaaccactctgtaaatgcacataaagaacaacctccttgagcaatctcaagcaagagaaagaagaggcttccgagctccagcaaaacaatgggaaaaaacatacccttatcttttccttctcattttcaaaggtaccgtgaatataagtagaagaaagacaccgtctcttcctttaaggaacttacagtcttatggaagagacacagatggaagtgcacaattaccgaatatcatcaaaaagcctgagaaaaagttatgcaaaagctactgtgtgagcacagaggctgtaaacctaatcctaagttgcaggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaa

SEQ ID NO: 16533 - DNA, 3273 bp, Homo sapiens
agcagggaaatccggatgtctcggttatgaagtggagcagtgagtgtgagcctcaacatagttccagaactctccatccggactagttattgagcatctgcctctcatatcaccagtggccatctgaggtgtttccctggctctgaaggggtaggcacgatggccaggtgcttcagcctggtgttgcttctcacttccatctggaccacgaggctcctggtccaaggctctttgcgtgcagaagagctttccatccaggtgtcatgcagaattatggggatcacccttgtgagcaaaaaggcgaaccagcagctgaatttcacagaagctaaggaggcctgtaggctgctgggactaagtttggccggcaaggaccaagttgaaacagccttgaaagctagctttgaaacttgcagctatggctgggttggagatggattcgtggtcatctctaggattagcccaaaccccaagtgtgggaaaaatggggtgggtgtcctgatttggaaggttccagtgagccgacagtttgcagcctattgttacaactcatctgatacttggactaactcgtgcattccagaaattatcaccaccaaagatcccatattcaacactcaaactgcaacacaaacaacagaatttattgtcagtgacagtacctactcggtggcatccccttactctacaatacctgcccctactactactcctcctgctccagcttccacttctattccacggagaaaaaaattgatttgtgtcacagaagtttttatggaaactagcaccatgtctacagaaactgaaccatttgttgaaaataaagcagcattcaagaatgaagctgctgggtttggaggtgtccccacggctctgctagtgcttgctctcctcttctttggtgctgcagctggtcttggattttgctatgtcaaaaggtatgtgaaggccttcccttttacaaacaagaatcagcagaaggaaatgatcgaaaccaaagtagtaaaggaggagaaggccaatgatagcaaccctaatgaggaatcaaagaaaactgataaaaacccagaagagtccaagagtccaagcaaaactaccgtgcgatgcctggaagctgaagtttagatgagacagaaatgaggagacacacctgaggctggtttctttcatgctccttaccctgccccagctggggaaatcaaaagggccaaagaaccaaagaagaaagtccacccttggttcctaactggaatcagctcaggactgccattggactatggagtgcaccaaagagaatgcccttctccttattgtaaccctgtctggatcctatcctcctacctccaaagcttcccacggcctttctagcctggctatgtcctaataatatcccactgggagaaaggagttttgcaaagtgcaaggacctaaaacatctcatcagtatccagtggtaaaaaggcctcctggctgtctgaggctaggtgggttgaaagccaaggagtcactgagaccaaggctttctctactgattccgcagctcagaccctttcttcagctctgaaagagaaacacgtatcccacctgacatgtccttctgagcccggtaagagcaaaagaatggcagaaaagtttagcccctgaaagccatggagattctcataacttgagacctaatctctgtaaagctaaaataaagaaatagaacaaggctgaggatacgacagtacactgtcagcagggactgtaaacacagacagggtcaaagtgttttctctgaacacattgagttggaatcactgtttagaacacacacacttactttttctggtctctaccactgctgatattttctctaggaaatatacttttacaagtaacaaaaataaaaactcttataaatttctatttttatctgagttacagaaatgattactaaggaagattactcagtaatttgtttaaaaagtaataaaattcaacaaacatttgctgaatagctactatatgtcaagtgctgtgcaaggtattacactctgtaattgaatattattcctcaaaaaattgcacatagtagaacgctatctgggaagctatttttttcagttttgatatttctagcttatctacttccaaactaatttttatttttgctgagactaatcttattcattttctctaatatggcaaccattataaccttaatttattattaacatacctaagaagtacattgttacctctatataccaaagcacattttaaaagtgccattaacaaatgtatcactagccctcctttttccaacaagaagggactgagagatgcagaaatatttgtgacaaaaaattaaagcatttagaaaacttctttgctttcttatttacgtagatgcattatacctttcatgtaaaattaaagtgaggaccagatcatatcatattgtttgcaaaaataaaagggacaatgttggttgttaaaatacaagcatatgtcaaccaaacagcatatatcatatggggctattcatgctccaaacattttattttgagttggccaagtacatacacattaaacagtcctttactagagatgctggccctccatttccatccatttcagaattcaccagggagccagagatccaggatggctcattcgtctcacttttgaccgccctgcttctctagttttctctttccctcccgcttagactgctaattgtcttcttcccctcaccagtgaccccacagctccgtggttccttcggcccagatgccacaacctgctggcataatcttttccggttggcccacggagtataatcttaaaatttgatttcatttccaggcattaaaaatcaagagatttcacatggttacatttctgggttccctctaaaaatggaaagatctggaagtaaagaacccatgttccctcatagcaatcattatctgatactgagtagcagctgtcccctttcaatggggtctgctctttttgtttcaccacagtcctcatgactctctgttgcacactcatgccaaagtaaaggtgccctttcctatgaactttgtaacactgtggccttttcttcacacccagcccacgtccctcatatatatcacctgcctgccccagtaggtctatgagtttgaaactggtttgtcagtccttaagctttatcagcttcatccatttctcagggagtaaagaagaaaagagggaaagcgcctaagtagtgatcttccctctgtgtgttagctgaaa

SEQ ID NO: 16534 - DNA, 804 bp, Homo sapiens
gcccacccccgcccagcccgtgcctataaggccttggcaatgcaggggcccgcactgctcccagacgacatcagagatgaggacagcattgctgctccttgcagccctggctgtggctacagggccagcccttaccctgcgctgccacgtgtgcaccagctccagcaactgcaagcattctgtggtctgcccggccagctctcgcttctgcaagaccacgaacacagtggagcctctgagggggaatctggtgaagaaggactgtgcggagtcgtgcacacccagctacaccctgcaaggccaggtcagcagcggcaccagctccacccagtgctgccaggaggacctgtgcaatgagaagctgcacaacgctgcacccacccgcaccgccctcgcccacagtgccctcagcctggggctggccctgagcctcctggccgtcatcttagcccccagcctgtgaccttccccccagggaaggcccctcatgcctttccttccctttctctggggattccacacctctcttccccagccgcaacgggggtgccaggagccccaggctgagggcttccccgaaagtctgggaccaggtccaggtgggcatggaatgctgatgacttggagcaggccccacagaccccacagaggatgaagccaccccacagaggatgcagcccccagctgcatggaaggtggaggacagaagccctgtggatccccggatttcacactccttctgttttgttgccgtttatttttgtactcaaatctctacatggagataaatgatttaaaccagtg

SEQ ID NO: 16535 - DNA, 1181 bp, Homo sapiens
cccggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccagct

SEQ ID NO: 16536 - DNA, 1173 bp, Homo sapiens
ccggggccgcgcggctgcctgggaggctccgggccagccgcggtccagagcgcgcgaggttcggggagctcggccaggctgctggtacctgcgtccgcccggcggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccag

SEQ ID NO: 16537 - DNA, 1335 bp, Homo sapiens
gaacagcccagcctggagcgggaagcagggacaagatgacctcaggaatcccaggctgcgggggtgcctgcgtcctcccctcccgagctccactccgcaggcgagacccccaacactgctccccgacactctccgaggcacccctcctccgtgctcacacccaaacacgtctgctcacccgtgggcttcccaccccgaacacaacgaggactgtccaggtgtcagtgacggtcaccccgacctggtcccctgtccggcctcgccaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccag

SEQ ID NO: 16538 - DNA, 1419 bp, Homo sapiens
cagagcgcgcgaggttcggggagctcggccaggctgctggtacctgcgtccgcccggcggcctccccgaatgtttccaaagatctggggcgggagcgggcggagactgccgccaggagcctcccggccgccccagggctgcgcagccactggagcccatcacccaactccagacgctcctggctcctctacgtgggccgggagggacagccttgaggactaggggagggggcacgggaccttgcagagctcctggccggaaagggaggattgaccgcccccggcatatcaccccggagcactggaacccgcccccgcttcttgttttggcactggtggtgcttgcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 16539 - DNA, 740 bp, Homo sapiens
agagcgcgcgaggttcggggagctcggccaggctgctggtacctgcgtccgcccggcgggtctcactctgttgcccaggctgcagtgcagtggcatgatcatagttcacttcagtcttgaactccctggctcaagagatcctcccacctcagcctcccaagtagctgaccacagagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttg

SEQ ID NO: 16540 - DNA, 1256 bp, Homo sapiens
cagccgcggtccagagcgcgcgaggttcggggagctcggccaggctgctggtacctgcgtccgcccggcgggtctcactctgttgcccaggctgcagtgcagtggcatgatcatagttcacttcagtcttgaactccctggctcaagagatcctcccacctcagcctcccaagtagctgaccacaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccagc

SEQ ID NO: 16541 - DNA, 868 bp, Homo sapiens
caggctgctggtacctgcgtccgcccggcggcctccccgaatgtttccaaagatctggggcgggagcgggcggagactgccgccaggagcctcccggccgccccagggctgcgcagccactggagcccatcacccaactccagacgctcctggctcctctacgtgggccgggagggacagccttgaggactaggggagggggcacgggaccttgcagagctcctggccggaaagggaggattgaccgcccccggcatatcaccccggagcactggaacccgcccccgcttcttgttttggcactggtggtgcttgcggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatc

SEQ ID NO: 16542 - DNA, 857 bp, Homo sapiens
ttcggggagctcggccaggctgctggtacctgcgtccgcccggcggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctggggg

SEQ ID NO: 16543 - DNA, 402 bp, Homo sapiens
atgaaaccccagtttgttgggatcttgctcagctccctgctaggggctgccttgggaaaccgaatgcggtgctacaactgtggtggaagccccagcagttcttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatag

SEQ ID NO: 16544 - DNA, 523 bp, Homo sapiens
atgaaaccccagtttgttgggatcttgctcagctccctgctaggggctgccttgggaaaccgaatgcggtgctacaactgtggtggaagccccagcagttcttgcaaagaggccgtgaccacctgtggcgagggcagaccccagccaggcctggaacagatcaagctacctggaaaccggaggtgttttttgagggggctgaaaatccctttgggctccttgaaatcacatctgctctgccccagaaggcaagtcctgaagccaggagtccaacaccccagtttcattctctctctcagccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatag

SEQ ID NO: 16545 - DNA, 402 bp, Homo sapiens; identical to SEQ ID NO: 16543

SEQ ID NO: 16546 - DNA, 1266 bp, Homo sapiens
cccatggcagtcttattcctcctcctgttcctatgtggaactccccaggctgcagacaacatgcaggccatctatgtggccttgggggaggcagtagagctgccatgtccctcaccacctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttggagggatccaaagaggaagatgccgggcggtactggtgcactgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccaggcagaggaaaccgaatgcggtgctacaactgtggtggaagccccagcagttcttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatagggggagtaggagtagagaagggaacaagggagcaagggaacaagggacatctgaacatctaatgtgagaagacaaacatccttctgtgagtcattaaaatctatgaaccactct

SEQ ID NO: 16547 - DNA, 402 bp, Homo sapiens; identical to SEQ ID NO: 16543

SEQ ID NO: 16548 - DNA, 402 bp, Homo sapiens; identical to SEQ ID NO: 16543

SEQ ID NO: 16549 - DNA, 1266 bp, Homo sapiens
cccatggcagtcttattcctcctcctgttcctatgtggaactccccaggctgcagacaacatgcaggccatctatgtggccttgggggaggcagtagagctgccatgtccctcaccacctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttggagggatccaaagaggaagatgccgggcggtactggtgcgctgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccaggcagaggaaaccgaatgcggtgctacaactgtggtggaagccccagcagttcttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatagggggagtaggagtagagaagggaacaagggagcaagggaacaagggacatctgaacatctaatgtgagaagacaaacatccttctgtgagtcattaaaatctatgaaccactct

SEQ ID NO: 16550 - DNA, 402 bp, Homo sapiens
atgaaaccccagtttgttgggatcttgctcagctccctgctaggggctgccttgggaaaccgaatgcggtgctacaactgtggtggaagccccagcagtacttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatag

SEQ ID NO: 16551 - DNA, 402 bp, Homo sapiens; identical to SEQ ID NO: 16543

SEQ ID NO: 16552 - DNA, 402 bp, Homo sapiens; identical to SEQ ID NO: 16543

SEQ ID NO: 16553 - DNA, 523 bp, Homo sapiens; identical to SEQ ID NO: 16544

SEQ ID NO: 16554 - DNA, 951 bp, Homo sapiens
ggtccgcgtctgcggctgcgttccccgaaagacgaggctgcgcccggattccggtccgcagggagaccgaagggcacagctccccgcgccgcgcacgccgcccgagcccggagtgcggacacccccgggatgcttgcgccccagaggacccgcgccccaagcccccgcgccgcccccaggcccacccggagcatgctgcctgcagccatgaagggcctcggcctggcgctgctggccgtcctgctgtgctcggcgcccgctcatggcctgtggtgccaggactgcaccctgaccaccaactccagccattgcaccccaaagcagtgccagccgtccgacacggtgtgtgccagtgtccgaatcaccgatcccagcagcagcaggaaggatcactcggtgaacaagatgtgtgcctcctcctgtgacttcgttaagcgacactttttctcagactatctgatggggtttattaactctgggatcttaaaggtcgacgtggactgctgcgagaaggatttgtgcaatggggcggcaggggcagggcacagcccctgggccctggccggggggctcctgctcagcctggggcctgccctcctctgggctgggccctgatgtctcctccttcccacggggcttctgagcttgctcccctgagcctgtggctgccctctccccagcctggcgtggctggggctgggggcagccttggcccagctccgtggctgtggcctgtggctctcactcctcccccgacgtgaagcctccctgtctctccgccagctctgagtcccaggcagctggacatctccaggaaaccaggccatctgggcaggaggcctggggatgagggtggggggggacccccaggtcccggaggggaagtgaagcaacagcccagctggaagggcgtcttctgcggagaaataaagtcacttttgagtcctgaga

SEQ ID NO: 16555 - DNA, 1056 bp, Homo sapiens
gaccccaggggtctgcgaacccggacctgcgcgtggcgccgcgccgggtacctccccctctctgcgtctttgtgcattttgcttcctttcgcagtaaacgttcttccgagaaattccaaggggatctcagccaagcagagggggaagggatcctgcccacgcctggggagaccgaagggcacagctccccgcgccgcgcacgccgcccgagcccggagtgcggacacccccgggatgcttgcgccccagaggacccgcgccccaagcccccgcgccgcccccaggcccacccggagcatgctgcctgcagccatgaagggcctcggcctggcgctgctggccgtcctgctgtgctcggcgcccgctcatggcctgtggtgccaggactgcaccctgaccaccaactccagccattgcaccccaaagcagtgccagccgtccgacacggtgtgtgccagtgtccgaatcaccgatcccagcagcagcaggaaggatcactcggtgaacaagatgtgtgcctcctcctgtgacttcgttaagcgacactttttctcagactatctgatggggtttattaactctgggatcttaaaggtcgacgtggactgctgcgagaaggatttgtgcaatggggcggcaggggcagggcacagcccctgggccctggccggggggctcctgctcagcctggggcctgccctcctctgggctgggccctgatgtctcctccttcccacggggcttctgagcttgctcccctgagcctgtggctgccctctccccagcctggcgtggctggggctgggggcagccttggcccagctccgtggctgtggcctgtggctctcactcctcccccgacgtgaagcctccctgtctctccgccagctctgagtcccaggcagctggacatctccaggaaaccaggccatctgggcaggaggcctggggatgagggtggggggggacccccaggtcccggaggggaagtgaagcaacagcccagctggaagggcgtcttctgcggagaaataaagtcacttttgagtcctgaga

SEQ ID NO: 16556 - DNA, 925 bp, Homo sapiens
agtggcaggtcccacccgctcccgcccctgccgctcattcctgtccggacgcacctgcagctccccggggagaagaggacgccccccatccgctcccccacacaggcttgcgccccagaggacccgcgccccaagcccccgcgccgcccccaggcccacccggagcatgctgcctgcagccatgaagggcctcggcctggcgctgctggccgtcctgctgtgctcggcgcccgctcatggcctgtggtgccaggactgcaccctgaccaccaactccagccattgcaccccaaagcagtgccagccgtccgacacggtgtgtgccagtgtccgaatcaccgatcccagcagcagcaggaaggatcactcggtgaacaagatgtgtgcctcctcctgtgacttcgttaagcgacactttttctcagactatctgatggggtttattaactctgggatcttaaaggtcgacgtggactgctgcgagaaggatttgtgcaatggggcggcaggggcagggcacagcccctgggccctggccggggggctcctgctcagcctggggcctgccctcctctgggctgggccctgatgtctcctccttcccacggggcttctgagcttgctcccctgagcctgtggctgccctctccccagcctggcgtggctggggctgggggcagccttggcccagctccgtggctgtggcctgtggctctcactcctcccccgacgtgaagcctccctgtctctccgccagctctgagtcccaggcagctggacatctccaggaaaccaggccatctgggcaggaggcctggggatgagggtggggggggacccccaggtcccggaggggaagtgaagcaacagcccagctggaagggcgtcttctgcggagaaataaagtcacttttgagtcctgaga

SEQ ID NO: 16557 - DNA, 2440 bp, Homo sapiens
cttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataa

SEQ ID NO: 16558 - DNA, 2049 bp, Homo sapiens
gctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcaggaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcagg

SEQ ID NO: 16559 - DNA, 1463 bp, Homo sapiens
gaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataa

SEQ ID NO: 16560 - DNA, 2340 bp, Homo sapiens
gctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcagg

SEQ ID NO: 16561 - DNA, 2451 bp, Homo sapiens
gctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcagg

SEQ ID NO: 16562 - DNA, 1522 bp, Homo sapiens
gaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgtgagtctctgggcagggcacccatcaccagattccttctctgaaagctttctcctctgctgccttctccaccttccgcttctccaagggtcttccctcatactgaaatgcctcagaccactaggacagctgttcagttcacaccagttgattcataggaggcaaactcatgactagctgctggacaagtctacccgccaaagtgctgggattacaggcatgagccatggcacctggccccaacctgcatttttataaactattatcattttgaataaggccaaagttggctggggtgaaatcagagaagactgaggagaagcccttggtgtccaaagacactgtggcctccaagaaggtgggccactcagttcccctgggggtgaggaacagaatttgcattctacctcctcagccctgggcctcacaggagctt

SEQ ID NO: 16563 - DNA, 2275 bp, Homo sapiens
ctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataa

SEQ ID NO: 16564 - DNA, 1364 bp, Homo sapiens
catggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgcaccatttattgaaaagttgtccgtccacgtcatcgagggtgaccaccgcacactcctggagggcagcggcctggagtccatcatcagcaccctggctgagccacgtgtgagcgtgcgggagggctaggccctcgcccccacctgccactggagaccgctccgccatccccacctcaccgccgcgcagcagagctggaagggtcctgccgatgggaccctgccaggcccagtgccactgccccccgaggctgctagacgtgggcgttaggcgtgtcccacccacccgccgcctcccatggcacgtcgggaacaccggagccgccaacttggagactcctggtctgtgaagagccgctgacgcccgcaggaaccgggctgggccttgtgtgccagtggggtttgtgcttggtctttctccgcttggatttgcttatttattgcattgctggtagagactcccaagcctgtccaccctgcaaagactcctcgggcagcatgcgggtcccgcacactgcacccatttcctggatgtcccctgcaggcgcgggaggccatccgggcctgctggctgcggccccctctcagccaggcctggctcagcccactgcgtgggaggtcaccggccactccccgaggagctgggatccccgggatgcaggcccacagtgcggggctgcacccatgatgcggagctggcctccaaccctgcgggccgcgccaggcaccaactcagtgtttgtcagtgtttgtttttccaagaaatggttcaaattgctgctcagatttttaaatttactgtagctgccagtgtacacgtgtggaccccattttatttttacaccaatttggtgaaaatgctgctttcctcagcctccccacaattaaactgcacatggtctctaaaaaaa

SEQ ID NO: 16565 - DNA, 2090 bp, Homo sapiens
cagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataa

SEQ ID NO: 16566 - DNA, 3787 bp, Homo sapiens
caggtgatttttggtggggcggggacatgaaaaaaaagttaaaatgtccttataaagacaaaatctttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcaaagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccttgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggacaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccct

SEQ ID NO: 16567 - DNA, 3903 bp, Homo sapiens
ggtgttgatgaacctgtgtgtgcagtcatagatacatcgtgtgtgtttgcaaaaatggcgaatgaggaaagatccagctctgacagaataatgagttgtgcaaagtgaaggccaaatgacatcaccggagatagcagtagttcaaagaaagcaaagcagaggaattgaactgctgcaaaatgcacgattcctccggcctcagatgaccaggcaccactagatacagaacactgtgctttccttctccaagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcaaagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccttgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggacaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaa

SEQ ID NO: 16568 - DNA, 819 bp, Homo sapiens
atctgcctggggccagtgaggagaatgcatctagacagagcttttcgtgctgctgagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaa

SEQ ID NO: 16569 - DNA, 1552 bp, Homo sapiens
tttctcagcatttcttattgccgtgactgttaatgatccatgcgtagctacaggaatatctgttcacatgtccatttgctatgtgtgcagaggatggagactccaaattttccatgtcaatctccatgaattcaccttttttagaaatattacatcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcaaagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccttgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatccttta

SEQ ID NO: 16570 - DNA, 753 bp, Homo sapiens
ggcgggcgccgggaggggcaggcccagcccacggtgcagcgcgcgcggagccctcgccttcctccgacgcactgtggggctgcaggggaagctgcgggccgtgggggccggaggagaagccggctccacgcgcagctgctggcgaatgaggaaagatccagctctgacagaataatgagttgtgcaaagtgaaggccaaatgacatcaccggagatagcagtagttcaaagaaagcaaagcagaggaattgaactgctgcaaaatgcacgagtctcaaacattgtctcagcagcagcatcatatcttacaaaagttgaggaaatactgtatttccagcttaggaaactgaagattcctccggcctcagatgaccaggcaccactagatacagaacactgtgctttccttctccaagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagat

SEQ ID NO: 16571 - DNA, 4678 bp, Homo sapiens
gacaactgtaaagaggcagctgaaagaatcccagtctttgatggtgggaggggaaagtggttggaaagcattaaaaaaacatgctccagcagttcactgatgtgggaaattgtctgtatttcaggtcaaccgtcaggatagattttggtctgcaaagccccagctgagcaagaatgcagtgtagacatatgggtgcccagagtttaaaggaaaattactcagactcacattggagtttaagaccccttcattgcctctcctactgggttggggtgactggagccagtggggaattaccaaccctgtggctctctctgcatctcaagcctccagagctgggcttccttgtttacttatttagagcccagcagaggaagtggtaaaggaaactagctgagtcgttttctgagaagagaccatatttgttcgcagaggaagccgttgctttctgggatctggctacgccagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggctggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccataatttatttattcttcttcaatgtttgtaaagtgcatgagtcatgttcacacttgaagtctagtagtgcactgtaataattcattttttaaaagattatttaatgcccatttcaaaatacagtagtttacacagctacagaaacaatttggggcaagttttaaaacactgaaacagtaatagttattggtgtcacataaaactgatttgttttttacagccaaacctctgtcagtcagaggcattcattagttttatacatgtaatttgaaaatcactaaacctcgttttctcagcagcaataatttaagaggcttcaaaaatataatttcactcttatttagtattttttcctgggggcatttttacgtaatttttttatgaaaagacaaatgcatgttgagataacttctgggattaaaatagtcttttgctttacttttttggtttcctaaaacaactttattgacttttagtccatactgttatatttttgtcttaaagaaaatttaaactacaaataccaaaagaaaacattttaaatttagggatgagactttggtgtatcgtgggtctaggtttaatgaacacatctggggttaagttggcatttcttcacatctccacacccacaccaaccatcacagccccccaccaaccttctcccaaccccaaaagcattgtccagggatatagattttaccaaaggcttcctgggaagacgagggagcaacactttagattaaatgtgatcagactttcctattagatatggctcttctgtctcttgttatccccctgacagctctgccataaagtcccttctcctcatccttcccaaacaggctgtataagtgctttgaggtaattaaactctttcctccagtttacaaatatcacttaacaaaaaatataggcattcagccagattaaaaaactggtattcagccaaatagtgacaatcagttgttcttcaagtttttccctttgggaccttggttgttattgcacaacttttattagcaacaatttttggcgtctctgcttaatctacaagttttcgaaatggaaaagagtatcttgcagcttcattttcatgagctaataaaaggggtattggaaggaatctaagaagtcaccattttaaaactgatgatatgttaaaataaggagtatgcagaaggtagagacttttaactgatgataaaaatggtgtttcacaaaatctcatccttaacaaccagaagttctcagtttagggtccaaaacttgggagtttaaggctgaaaaccctgcattcatttacacgtctacacaacgggctattcagcaagtatttacttagtggctcttctgtgttaaacaagtgagctaggtacaaggtagtaaggatagcatacaccataggttctagtatcgagtaagctccacttgtcttgctttgccgtattctatctttacaattcaaaaatatctaaaatgaaggacctgatagatttcaaagcaactatttggtagcgaatcatgtttataaaacaaaccaaagctcattttaagtctattagtggaaagtgccatcaggattaagatgttctgttccatggctatgactgaaatcaatgttgggaagctaatgttttcatgactagcattctctctctgttcaagcaccgacaactccttttggctgggccttgcctcttttggccacagaccttctatatgaccccaggtgcatcagtcacagttgctcagaaccctgctcagtgataaacatcttactaaagctgggtcaatcagggtcactctctggaatgttaaacatgaagcctgagacaagatctctcttttatctggggtccccaaaggcaatgctgtacacttggagctgcctgctgccctgcaactactcccatttaccaattatctggaagaaccagtctacaatagaagacaacgaggccaacacacaaaaacacagtaaaagtatggacaaattagtgggatccctgaaatctattccaactatgtgcttccaagtcacatgactcaataaatgcttcagctggttgagttgtgcttggcgttcactaccaggagagttctgattaataaaaactcattccatcaattaataatttagtagctctctttcaacctgagccaaattcaagcataagctaaaggataagcagtgacccatggccaatttcctatgtcatacacttgccattagtgacgtaagttaagccattcttcaaaacattaaacagccttcaagaaca

SEQ ID NO: 16572 - DNA, 1974 bp, Homo sapiens
agagaccagcagaacggcatcccagccacgacggccactttgctctgtctgctctccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgatgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccagctgtaccagggggagaggcttcttggagcagcagtgtacttcacagagctgtctagcccaggtgcccaacgctctgggagagccccaggtgccctcccagcaggccacctcctgctgtttctcatccttggtgtcctttctctgctccttttggtgactggagcctttggctttcacctttggagaagacagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaactccctgtcagcagc

SEQ ID NO: 16573 - DNA, 1699 bp, Homo sapiens
acaccctgacccaagccgagacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggagaaactgcaggtcaagggctgataacggccatgcaggatgcttgatgctgcgtcccccgctgcttgccgccccccaccccgccattttgtataataaagctccctgtgtattctca

SEQ ID NO: 16574 - DNA, 1785 bp, Homo sapiens
gggctggaagtcggtcttcggacagagcccgtcctgcccagaagcccaggcgagccagcagcaggggtgcagggaccgagtggcccagccccctgggcagggtgtcagggccagagcccagaggacggcggttcaggcttcagtcccagccggcgaaccagagctgggcagagcggccagcaagcggcagccagggtgccctgggcactcgacccccagatgcccctgctggaaccgtaaaggggaggcaccctgaggccagagggagcatggccccggggactgagcatccggctcagagcggcttggcagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggagaaactgcaggtcaagggctgataacggccatgcaggatgcttgatgctgcgtcccccgctgcttgccgccccccaccccgccattttgtataataaagctccctgtgtattctca

SEQ ID NO: 16575 - DNA, 2640 bp, Homo sapiens
ataccccattttgcaaacaggaaagctgaggctcagggaggcaccaaagcttactcccatcctggggcttggcagggggtgcccgcagcacccggggacatacaccggggagtctcctgggaaagaagtgccggcccaggggcagactcttttctgctctgccatgtcttccctgcacccccagggatgatgagtctgggaggggctggtcagccatgaaagcttcggggaggggccggtggccaggccgggcaccccagagctccacaggcagacatggtgtgggggtgtcaggaagagggcctggctgctgggtgctacggtaggaagatcccggtgctgtgggagtggagcaggtggttgaatgccaggctggcttggtccttctctctgggtgccggctgtggctcccgcccaggtgggcaccacgtctgaataatgtatgaagcctctggttgcgtggaggatgggagcgcttcgggcagcatctgtgggcagagacttcagggatgtgaggtacatctgggcatggctagctgggaaggaaagaggatggcagagcctcgagccgttgccagggactggttgcgtgtcccagaacgtgccaaaagcctgcctcgtgagcacggcaagagctctgccagggcagtcccagctggcccaggcgccgcagcgctcccgagggccgtcgagcaaaggcgggaggcgcagccgggctgtcggtggacctgtaggtatcagggctccttggtcccctcctgcgggaagcaggcaccgagtggggctgcatgtagacgcatgcgagggtgagagctgcggcggaggacgctgatcgcggagtgcaggcgagggccccagaaaggtcccgcaggtcgcctcgctcgtggcacgggctcggcagcgttgtggttagtgacacggaggaagacagaaagccatatgcacagcacgcagaacaggaggaggggggaagaaagagcaggcacggggcaggcagagccgcagccacgccgccgggatgcagcaggcagggccacccacgagcagggcggggccctaacctccgacccaggctggtcgccgcagatgggggcagagatgtgaaacagctgcagagcgggacaagggtgctgccggcacagggctgaccacagagcacatcaaaagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggagaaactgcaggtcaagggctgataacggccatgcaggatgcttgatgctgcgtcccccgctgcttgccgccccccaccccgccattttgtataataaagctccctgtgtattctca

SEQ ID NO: 16576 - DNA, 887 bp, Homo sapiens
agggcagtcccagctggcccaggcgccgcagcgctcccgagggccgtcgagcaaaggcgggaggcgcagccgggctgtcggtggacctgcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaag

SEQ ID NO: 16577 - DNA, 682 bp, Homo sapiens
acagcctcacccttgcttccctcagtgttcccaaggtgctgcgcaaccccaactccctggcctggccagggtcatgatagctggggaggcaagaggtggctgttctccttgaatgtagggacagagggtggcatgggcagatgagtgcccgtgcacagatggtggcccaggactaattgggtggccagcggccggcagatctggctctggttctggctgtgccaggccctcactctgtgaccttggatgccagtgctgctggctggaccttggtttctccatcctggacatgggtacatggtggttctgagtgccagcgagctgggcaaaccgccggatgtgagactgccgtcgcggagctgaccctcggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctg

SEQ ID NO: 16578 - DNA, 968 bp, Homo sapiens
gagcctcctcactccccaggaccccagagaggacggaccctctccagccgccctctgggctcaggacagccgggtggggcagccacaggagctgcctgcagggggcagagtcgggacggggaccgagccggacacccattctgcaagtgtctgcagggggaggacggaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaag

SEQ ID NO: 16579 - DNA, 574 bp, Homo sapiens
gagacggggaaggaggggacgggacaaagaggaaccagcgaagggtccaggcctgcgatgatggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagc

SEQ ID NO: 16580 - DNA, 417 bp, Homo sapiens
gtgggctgagacccgggaggcttgagggtcggctgctacccatgacgggttggggaggtattggtgcgagctgaggtggtgcttgcggaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaa

SEQ ID NO: 16581 - DNA, 2016 bp, Homo sapiens
ggtcaggccaggtcgccgcctgagcagaggctgcagcctgggcagtcccgggcttctgaggaggaactctagcagacagggcctggatacctcttgagatgcagagagatggctccgatctggtccccacctggcagggtctccggctgtcacctgagttcaggaccagcaccaggatctgcagtgggcccctggctgggcacacctcatcccagcctccccctacccctggccccccataagcctcctcctcctgggcttccaggctctgctggtcagacctccctccctgcccaacgggaatgtgttttcccaggggacgctgctgtccaccaggagctctgtggcctgggatttgaggagtgcctggggtcaatcccccaggctcaccagtgctacttaacaaatgggcccaagagaaggaagtgcagcccccggaggaggggcagagcccctgcctggctgtgcggtggctcacccccttgtcaccaggggctcggccatgagcatccgtccagcgggcccagcaccaactgcagccccaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggagaaactgcaggtcaagggctgataacggccatgcaggatgcttgatgctgcgtcccccgctgcttgccgccccccaccccgccattttgtataataaagctccctgtgtattctca

SEQ ID NO: 16582 - DNA, 1507 bp, Homo sapiens
tcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccacacagcaggttctccccatgacaccacctgaacgtctcttcctcccaagggtgtgtggcaccaccctacacctcctccttctggggctgctgctggttctgctgcctggggcccaggggctccctggtgttggcctcacaccttcagctgcccagactgcccgtcagcaccccaagatgcatcttgcccacagcaacctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 16583 - DNA, 1422 bp, Homo sapiens
ccaggggctccacacagcaggtgaggctctcctgccccatctccttgggctgcccgtgcttcgtgctttggactaccgccccgcagtgtcctgccctctgcctgggcctcggtccctcctgcacctgctgcctggatccccggcctgcctgggcctgggccttggttctccccatgacaccacctgaacgtctcttcctcccaagggtgtgtggcaccaccctacacctcctccttctggggctgctgctggttctgctgcctggggcccaggggctccctggtgttggcctcacaccttcagctgcccagactgcccgtcagcaccccaagatgcatcttgcccacagcaacctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 16584 - DNA, 1422 bp, Homo sapiens
ccaggggctccgcacagcaggtgaggctctcctgccccatctccttgggctgcccgtgcttcgtgctttggactaccgcccagcagtgtcctgccctctgcctgggcctcggtccctcctgcacctgctgcctggatccccggcctgcctgggcctgggccttggttctccccatgacaccacctgaacgtctcttcctcccaagggtgtgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 16585 - DNA, 1422 bp, Homo sapiens; identical to SEQ ID NO: 16584

SEQ ID NO: 16586 - DNA, 1507 bp, Homo sapiens
tcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccgcacagcaggttctccccatgacaccacctgaacgtctcttcctcccaagggtgtgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 16587 - DNA, 1507 bp, Homo sapiens
tcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccgcacagcaggttctccccatgacaccacctgaacgtctcttcctcccaagggtgcgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 16588 - DNA, 1507 bp, Homo sapiens; identical to SEQ ID NO: 16586

SEQ ID NO: 16589 - DNA, 554 bp, Homo sapiens
gccccatctccttgggctgcccgtgcttcgtgctttggactaccgcccagcagtgtcctgccctctgcctgggcctcggtccctcctgcacctgctgcctggatccccggcctgcctgggcctgggccttggttctccccatgacaccacctgaacgtctcttcctcccaagggtgtgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggggtcgtcaccacctctcctttggccattccaacagctcaagtcttccctgatcaagtcaccggagctttcaaagaag

SEQ ID NO: 16590 - DNA, 1422 bp, Homo sapiens
ccaggggctccgcacagcaggtgaggctctcctgccccatctccttgggctgcccgtgcttcgtgctttggactaccgccccgcagtgtcctgccctctgcctgggcctcggtccctcctgcacctgctgcctggatccccggcctgcctgggcctgggccttggttctccccatgacaccacctgaacgtctcttcctcccaagggtgcgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 16591 - DNA, 1422 bp, Homo sapiens; identical to SEQ ID NO: 16590

SEQ ID NO: 16592 - DNA, 1422 bp, Homo sapiens; identical to SEQ ID NO: 16584

SEQ ID NO: 16593 - DNA, 1507 bp, Homo sapiens; identical to SEQ ID NO: 16586

SEQ ID NO: 16594 - DNA, 1507 bp, Homo sapiens; identical to SEQ ID NO: 16587

SEQ ID NO: 16595 - DNA, 554 bp, Homo sapiens
gccccatctccttgggctgcccgtgcttcgtgctttggactaccgccccgcagtgtcctgccctctgcctgggcctcggtccctcctgcacctgctgcctggatccccggcctgcctgggcctgggccttggttctccccatgacaccacctgaacgtctcttcctcccaagggtgcgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggggtcgtcaccacctctcctttggccattccaacagctcaagtcttccctgatcaagtcaccggagctttcaaagaag

SEQ ID NO: 16596 - DNA, 614 bp, Homo sapiens
gccccatctccttgggctgcccgtgcttcgtgctttggactaccgccccgcagtgtcctgccctctgcctgggcctcggtccctcctgcacctgctgcctggatccccggcctgcctgggcctgggccttggttctccccatgacaccacctgaacgtctcttcctcccaagggtgtgtggcaccaccctacacctcctccttctggggctgctgctggttctgctgcctggggcccaggggctccctggtgttggcctcacaccttcagctgcccagactgcccgtcagcaccccaagatgcatcttgcccacagcaacctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccagctcccagaagatggtgtatccagggctgcaggaaccctggctgcactcgatgtaccacggggctgcgttccagctcacccagggagaccagctatccacccacacagatggcatcccccacctagtcctcagccctag

SEQ ID NO: 16597 - DNA, 554 bp, Homo sapiens; identical to SEQ ID NO: 16589

SEQ ID NO: 16598 - DNA, 554 bp, Homo sapiens; identical to SEQ ID NO: 16589

SEQ ID NO: 16599 - DNA, 554 bp, Homo sapiens; identical to SEQ ID NO: 16595

SEQ ID NO: 16600 - DNA, 897 bp, Homo sapiens
cagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactggtaacggagacggccgaccccggggcacaggcccagcaaggactggggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaagat

SEQ ID NO: 16601 - DNA, 897 bp, Homo sapiens; identical to SEQ ID NO: 16600

SEQ ID NO: 16602 - DNA, 897 bp, Homo sapiens; identical to SEQ ID NO: 16600

SEQ ID NO: 16603 - DNA, 897 bp, Homo sapiens; identical to SEQ ID NO: 16600

SEQ ID NO: 16604 - DNA, 897 bp, Homo sapiens; identical to SEQ ID NO: 16600

SEQ ID NO: 16605 - DNA, 897 bp, Homo sapiens; identical to SEQ ID NO: 16600

SEQ ID NO: 16606 - DNA, 853 bp, Homo sapiens
ttcagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactgggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaagat

SEQ ID NO: 16607 - DNA, 897 bp, Homo sapiens; identical to SEQ ID NO: 16600

SEQ ID NO: 16608 - DNA, 897 bp, Homo sapiens; identical to SEQ ID NO: 16600

SEQ ID NO: 16609 - DNA, 1486 bp, Homo sapiens
gcgcccgcccccgaagcggcgcgggacgcctggcgccgtccgcgatccgcagggctgcccgcttaggcttaggcccggcccgctggcaaagccgagccgcagcattttatttcgttcgtggtttccgcacaggctggagtttcgtgggttgggtcgtacttgggacctcggcgaagaggacccgtttatttttttttctttccaaaatggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctgagcctttgaccccagataaacccctcccaattaatgcattttcatttcctactgatacaaggcctggagagggctgttgggggccctcagggagggttcaactctgagacgagaactgccttggtgaaggcaagttcaagcaccacttgagactgggggcagcatggagtagggcagggctacggggatacacggtgcaccctgcaacttatacctgagcccagtacaacaaaggtgacgggtgtgtaggtacacacccagagatggagcactgcagatcagcaacctcagccccacctgggaatttgctggaaatgcaggctcaagcccctccccacacctggtgaatgagagagccccagcctgacccaagcccagggcgactcccataccctgaagcctggggcatgctgggcagcaccggtgcccaaatctggctggtggacagaagcacctggagagttggagagctttttaaaaagacatctctcagcacttccctctctgcagattctgactcagtaagtgaggggtgaggcacagtcatttttctctattctgaagctctcccactgttttcaatgtttaaccaactggggacccctgctctttaagtatattacaggtaataaagatattgtttgtatgctttta

SEQ ID NO: 16610 - DNA, 794 bp, Homo sapiens
gcgcccgcccccgaagcggcgcgggacgcctggcgccgtccgcgatccgcagggctgcccgcttaggcttaggcccggcccgctggcaaagccgagccgcagcattttatttcgttcgtggtttccgcacaggctggagtttcgtgggttgggtcgtacttgggacctcggcgaagaggacccgtttatttttttttctttccaaaatggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacagatggactctcactctgtcgcccaggctggagtgcattggaacgatctcagctcactacaacctctgcctccctggttcaagcaattctcctgcctcagcctcccgagtagctgggattataggcgcacgccaccacgcctggctaatttttgtattcttagtagagatgtgatttcactgtattagtcaggctggtctcgaagtcctgacctcaagtgatccacctgcctcagcctcccaaagtgctgggattacaggtgtgaaccactgtgcccggcagacaattataatttttatgtagttacatttcacttcattgtctttgaattttgtgtcatgctgaattcccactccaagacaataaaaattctcttgcatttc

SEQ ID NO: 16611 - DNA, 1401 bp, Homo sapiens
atggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggtagctgagcaaggcacagccgccaggaggaagtcggggaacagcagccggagcctggggaagccctgcacaagttggccttgaggaaaccacctgacagacgtttgctcttcctcacagagctggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctgagcctttgaccccagataaacccctcccaattaatgcattttcatttcctactgatacaaggcctggagagggctgttgggggccctcagggagggttcaactctgagacgagaactgccttggtgaaggcaagttcaagcaccacttgagactgggggcagcatggagtagggcagggctacggggatacacggtgcaccctgcaacttatacctgagcccagtacaacaaaggtgacgggtgtgtaggtacacacccagagatggagcactgcagatcagcaacctcagccccacctgggaatttgctggaaatgcaggctcaagcccctccccacacctggtgaatgagagagccccagcctgacccaagcccagggcgactcccataccctgaagcctggggcatgctgggcagcaccggtgcccaaatctggctggtggacagaagcacctggagagttggagagctttttaaaaagacatctctcagcacttccctctctgcagattctgactcagtaagtgaggggtgaggcacagtcatttttctctattctgaagctctcccactgttttcaatgtttaaccaactggggacccctgctctttaagtatattacaggtaataaagatattgtttgtatgct

SEQ ID NO: 16612 - DNA, 3033 bp, Homo sapiens
ggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttttgttttttttttatattttgagaataaaacttcatataaaattg

SEQ ID NO: 16613 - DNA, 3058 bp, Homo sapiens
cggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgaaaggattattgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttttgttttttttttatattttgagaataaaacttcatataaaattg

SEQ ID NO: 16614 - DNA, 3059 bp, Homo sapiens
ggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgacactgtcaaggttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttttgttttttttttatattttgagaataaaacttcatataaaatt

SEQ ID NO: 16615 - DNA, 3811 bp, Homo sapiens
gcggccgagaagaggctggggctcgcggcgcggctgcagccgtcctgtgcgcgcggcgcgcggctccggagaggcgcccgcagtccagggcggcgcgcaccgcctcgctggcgctcagagcggtgccttttccccgagactcccggcacctcttcagcgcaaagattatttaatgtaatggcaactccacgggggaggacaaagaaaaaagcatcttttgatcattctccggatagccttcctttgaggagctccggtaggcaggcgaagaagaaagcaacagagacaacagatgaggatgaagatggtggctcagagaagaagtacaggaaatgtgaaaaggcaggctgtacggcaacatgtcctgtgtgctttgcaagtgcttctgaaagatgtgccaaaaatggctacacctcccgatggtatcatctctcctgtggggaacatttctgtaatgaatgctttgaccattactacagaagccataaggatggatatgacaaatatactacatggaaaaaaatatggactagcaatggcaaaaccgaacctagtcccaaagctttcatggcagaccagcaactcccctactgggttcagtgtacaaaacctgagtgtagaaaatggaggcagcttaccaaggaaatccagcttactccacagatagccaagacttatcgatgcggtatgaaaccaaatactgctattaagcctgagacctcagatcattgttccctcccagaggatctagaagctcttactcctcagaaatgtattcctcacatcatcgtccggggtctcgtgcgtattcgatgcgttcaggaagtggagagaatactgtattttatgaccagaaaaggtctcatcaacactggagttctcagcgtgggagccgaccagtatcttctccctaaggactaccacaataaatcagtcatcattatcggggctggtccagcaggattagcagctgctaggcaactgcataactttggaattaaggtgactgtcctggaagccaaagacagaattggaggccgagtctgggatgataaatcttttaaaggcgtcacagtgggaagaggagctcagattgtcaatgggtgtattaacaacccagtagcattaatgtgtgaacaagtatctgctcgctcgtgggaccacaatgaattctttgcccagtttgctggtgaccacactctgctaactcccgggtactcggtgataattgaaaaactggcagaagggcttgacattcaactcaaatctccagtgcagtgtattgattattctggagatgaagtgcaggttaccactacagatggcacagggtattctgcacaaaaggtattagtcactgtaccactggctttactacagaaaggtgccattcagtttaatccaccgttgtcagagaagaagatgaaggctatcaacagcttaggcgcaggcatcattgaaaagattgccttgcaatttccgtatagattttgggacagtaaagtacaaggggctgacttttttggtcacgttcctcccagtgccagcaagcgagggctttttgccgtgttctatgacatggatccccagaagaagcacagcgtgctgatgtctgtgattgccggggaggctgtcgcatccgtgaggaccctggatgacaaacaggtgctgcagcagtgcatggccacgctccgggagctgttcaaggagcaggaggtcccagatcccacaaagtattttgtcactcggtggagcacagacccatggatccagatggcatacagttttgtgaagacaggtggaagtggggaggcctacgatatcattgctgaagacattcaaggaaccgtctttttcgctggtgaggcaacaaacaggcatttcccacaaactgttacaggggcatatttgagtggcgttcgagaagcaagcaagattgcagcattttaagaattcggtggacccagctttcttctgtaccccagatggggaaatttgaatcacatgttaaacctcagttttataagagggggaaaaaaccgtctctacatagtaaaactgaaatgtttctaaggcgatatgataatgcaaacctatttcatcactctaaaagcactgacctcaaaaaaccttataagcacttagatttaattgcattttccataggttcaactactgctgaaagtctggatttcagaataaagcagaatgtaagtttcagttgaggccatggatttgattgttccatggctggaagttccctttagatttcacattttatatggctgatcaattttcatacattgagaaaccaagtcaatcaagcaggaatcatttaaaaaccagataaagccatgtttttcttctgtgacaatttatcagtatctttaccaatgagccttaatttttatataggtccaatattgagcttttacttaaaatttagatagaacttttttttggatacagcacaaactccagttgacagtaaaatgaagcttctaggtattttgtattgtacatatttcctcctactgggtgttcaaaagaaatttaaattcaagtaccttttgtgataaaatgttttagatttgtgcacccattggcaaaacaggaaagtttccagataggtattgtatcattgagaatgcagcacagatagtgtgggcttcacactatagacacagaatatagctttttcttaaagccaaatttgggtgataggacactttaaatatccttaattttggcaaccactagcaaaaaaacttgtcagaataatttaaccaagcccctctccacttcttttatttaaaagcactgattcaattgctaggaatatttttgcagatttttctttacagtattccataggcaggtccactggaaaactgcagaaaaatgtgagctctcctggtaaatagtatacattttataagctatattttaaaggcctaagaacatggcaagtatttacttttatcttttttttaaaaacactcatgacagaaaacagtttaataatatctcattctaaaataaaacactggttgcagggtcttcaggatgcctattttgccaagaaacttcagtatacaggttagaaatatgcttttgtttttgaacaataatatactggtttgctttaaagaagggactaaatatgactttaaagagacttcaaaatattgagtattttaaaaatttaaaagtaggtcagtttataacgagtaaatacctaacacaccaagaatgtgcagtgaacctcaggcatttaagacacctcccccaccgcccgccccccgccccccccaatcaaagtgtggtcccaaaacaagccaacagctgtatatctcaaaagttaacccaagacaactctgatatttaggttatttgttgagactcattggtactgactggcaagtattctgctttaaagtatcatgtattaaaatgtttagacagcatgtgttttaaagtgataaatgcaaaatgttaagtttgaaatggttaacagtaaattattatgttagtttccaggcacttgaactgtgctacaagtaggggaaaacctactttaaagtatggtaaatgtgtgttttaaacttcctatcaagtgacatacttcatttgattttttgtttaagaagccatggtacttttttcttgagttactttggatatgttttttcaatgccatctgaagattttgtaattgagtagcagtaaatatacagatttacaatgttttaactacagttcatgaatagctggttgtgtaaaactaataaaaaactagactttcacatgt

SEQ ID NO: 16616 - DNA, 3223 bp, Homo sapiens
gcagtccagggcggcgcgcaccgcctcgctggcgctcagagattatttaatgtaatggcaactccacgggggaggacaaagaaaaaagcatcttttgatcattctccggatagccttcctttgaggagctccggtaggcaggcgaagaagaaagcaacagagacaacagatgaggatgaagatggtggctcagagaagaagtacaggaaatgtgaaaaggcaggctgtacggcaacatgtcctgtgtgctttgcaagtgcttctgaaagatgtgccaaaaatggctacacctcccgatggtatcatctctcctgtggggaacatttctgtaatgaatgctttgaccattactacagaagccataaggatggatatgacaaatatactacatggaaaaaaatatggactagcaatggcaaaaccgaacctagtcccaaagctttcatggcagaccagcaactcccctactgggttcagtgtacaaaacctgagtgtagaaaatggaggcagcttaccaaggaaatccagcttactccacagatagccaagacttatcgatgcggtatgaaaccaaatactgctattaagcctgagacctcagatcattgttccctcccagaggatctaagagtattggaagtttccaaccattggtggtactctatgctcatcctacctcctttgctgaaagacagtgtggcagcgcccctgctgtctgcctactaccctgactgtgttggcatgagcccctcctgcaccagcacaaaccgcgccgctgccactggcaatgccagccctgggaagctggagcactccaaggctgccctctccgtgcacgttccaggcatgaaccgatacttccagcctttctaccagcccaatgagtgtggcaaagccctctgtgtgaggccggatgtgatggaactggatgagctctatgagtttccagagtattcccgagaccccaccatgtacctggctttgagaaacctcatcctcgcactgtggtatactaactgcaaagaagctcttactcctcagaaatgtattcctcacatcatcgtccggggtctcgtgcgtattcgatgcgttcaggaagtggagagaatactgtattttatgaccagaaaaggtctcatcaacactggagttctcagcgtgggagccgaccagtatcttctccctaaggactaccacaataaatcagtcatcattatcggggctggtccagcaggattagcagctgctaggcaactgcataactttggaattaaggtgactgtcctggaagccaaagacagaattggaggccgagtctgggatgataaatcttttaaaggcgtcacagtgggaagaggagctcagattgtcaatgggtgtattaacaacccagtagcattaatgtgtgaacaacttggcatcagcatgcataaatttggagaaagatgtgacttaattcaggaaggtggaagaataactgaccccactattgacaagcgcatggattttcattttaatgctctcttggatgttgtctctgagtggagaaaggataagactcagctccaagatgtccctttaggagaaaagatagaagaaatctacaaggcatttattaaggaatctggtatccaattcagtgagctggagggacaggtgcttcagttccatctcagtaacctggagtacgcctgtggcagcaaccttcaccaggtatctgctcgctcgtgggaccacaatgaattctttgcccagtttgctggtgaccacactctgctaactcccgggtactcggtgataattgaaaaactggcagaagggcttgacattcaactcaaatctccagtgcagtgtattgattattctggagatgaagtgcaggttaccactacagatggcacagggtattctgcacaaaaggtattagtcactgtaccactggctttactacagaaaggtgccattcagtttaatccaccgttgtcagagaagaagatgaaggctatcaacagcttaggcgcaggcatcattgaaaagattgccttgcaatttccgtatagattttgggacagtaaagtacaaggggctgacttttttggtcacgttcctcccagtgccagcaagcgagggctttttgccgtgttctatgacatggatccccagcacagcgtgctgatgtctgtgattgccggggaggctgtcgcatccgtgaggaccctggatgacaaacaggtgctgcagcagtgcatggccacgctccgggagctgttcaaggagcaggaggtcccagatcccacaaagtattttgtcactcggtggagcacagacccatggatccagatggcatacagttttgtgaagacaggtggaagtggggaggcctacgatatcattgctgaagacattcaaggaaccgtctttttcgctggtgaggcaacaaacaggcatttcccacaaactgttacaggggcatatttgagtggcgttcgagaagcaagcaagattgcagcattttaagaattcggtggacccagctttcttctgtaccccagatggggaaatttgaatcacatgttaaacctcagttttataagagggggaaaaaaccgtctctacatagtaaaactgaaatgtttctaaggcgatatgataatgcaaacctatttcatcactctaaaagcactgacctcaaaaaaccttataagcacttagatttaattgcattttccataggttcaactactgctgaaagtctggatttcagaataaagcagaatgtaagtttcagttgaggccatggatttgattgttccatggctggaagttccctttagatttcacattttatatggctgatcaattttcatacattgagaaaccaagtcaatcaagcaggaatcatttaaaaaccagataaagccatgtttttcttctgtgacaatttatcagtatctttaccaatgagccttaatttttatataggtccaatattgagcttttacttaaaatttagatagaacttttttttggatacagcacaaactccagttgacagtaaaatgaagcttctaggtattttgtattgtacatatttcctcctactgggtgttcaaaagaaatttaaattcaagtaccttttgtgataaaatgttttagatttgtgcacccattggcaaaacaggaaagtttccagataggtattgtatcattgagaatgcagcac

SEQ ID NO: 16617 - DNA, 4574 bp, Homo sapiens
agtcctgtcggctcctcccaccccgggtcacgccgtgacaggggcggaagcggcggcggcggcggcggccgagaagaggctggggctcgcggcgcggctgcagccgtcctgtgcgcgcggcgcgcggctccggagaggcgcccgcagtccagggcggcgcgcaccgcctcgctggcgctcagagcggtgccttttccccgagactcccggcacctcttcagcgcaaagattatttaatgtaatggcaactccacgggggaggacaaagaaaaaagcatcttttgatcattctccggatagccttcctttgaggagctccggtaggcaggcgaagaagaaagcaacagagacaacagatgaggatgaagatggtggctcagagaagaagtacaggaaatgtgaaaaggcaggctgtacggcaacatgtcctgtgtgctttgcaagtgcttctgaaagatgtgccaaaaatggctacacctcccgatggtatcatctctcctgtggggaacatttctgtaatgaatgctttgaccattactacagaagccataaggatggatatgacaaatatactacatggaaaaaaatatggactagcaatggcaaaaccgaacctagtcccaaagctttcatggcagaccagcaactcccctactgggttcagtgtacaaaacctgagtgtagaaaatggaggcagcttaccaaggaaatccagcttactccacagatagccaagacttatcgatgcggtatgaaaccaaatactgctattaagcctgagacctcagatcattgttccctcccagaggatctaagagtattggaagtttccaaccattggtggtactctatgctcatcctacctcctttgctgaaagacagtgtggcagcgcccctgctgtctgcctactaccctgactgtgttggcatgagcccctcctgcaccagcacaaaccgcgccgctgccactggcaatgccagccctgggaagctggagcactccaaggctgccctctccgtgcacgttccaggcatgaaccgatacttccagcctttctaccagcccaatgagtgtggcaaagccctctgtgtgaggccggatgtgatggaactggatgagctctatgagtttccagagtattcccgagaccccaccatgtacctggctttgagaaacctcatcctcgcactgtggtatactaactgcaaagaagctcttactcctcagaaatgtattcctcacatcatcgtccggggtctcgtgcgtattcgatgcgttcaggaagtggagagaatactgtattttatgaccagaaaaggtctcatcaacactggagttctcagcgtgggagccgaccagtatcttctccctaaggactaccacaataaatcagtcatcattatcggggctggtccagcaggattagcagctgctaggcaactgcataactttggaattaaggtgactgtcctggaagccaaagacagaattggaggccgagtctgggatgataaatcttttaaaggcgtcacagtgggaagaggagctcagattgtcaatgggtgtattaacaacccagtagcattaatgtgtgaacaacttggcatcagcatgcataaatttggagaaagatgtgacttaattcaggaaggtggaagaataactgaccccactattgacaagcgcatggattttcattttaatgctctcttggatgttgtctctgagtggagaaaggataagactcagctccaagatgtccctttaggagaaaagatagaagaaatctacaaggcatttattaaggaatctggtatccaattcagtgagctggagggacaggtgcttcagttccatctcagtaacctggagtacgcctgtggcagcaaccttcaccaggtatctgctcgctcgtgggaccacaatgaattctttgcccagtttgctggtgaccacactctgctaactcccgggtactcggtgataattgaaaaactggcagaagggcttgacattcaactcaaatctccacaggtgcagtgtattgattattctggagatgaagtgcaggttaccactacagatggcacagggtattctgcacaaaaggtattagtcactgtaccactggctttactacagaaaggtgccattcagtttaatccaccgttgtcagagaagaagatgaaggctatcaacagcttaggcgcaggcatcattgaaaagattgccttgcaatttccgtatagattttgggacagtaaagtacaaggggctgacttttttggtcacgttcctcccagtgccagcaagcgagggctttttgccgtgttctatgacatggatccccagaagaagcacagcgtgctgatgtctgtgattgccggggaggctgtcgcatccgtgaggaccctggatgacaaacaggtgctgcagcagtgcatggccacgctccgggagctgttcaaggagcaggaggtcccagatcccacaaagtattttgtcactcggtggagcacagacccatggatccagatggcatacagttttgtgaagacaggtggaagtggggaggcctacgatatcattgctgaagacattcaaggaaccgtctttttcgctggtgaggcaacaaacaggcatttcccacaaactgttacaggggcatatttgagtggcgttcgagaagcaagcaagattgcagcattttaagaattcggtggacccagctttcttctgtaccccagatggggaaatttgaatcacatgttaaacctcagttttataagagggggaaaaaaccgtctctacatagtaaaactgaaatgtttctaaggcgatatgataatgcaaacctatttcatcactctaaaagcactgacctcaaaaaaccttataagcacttagatttaattgcattttccataggttcaactactgctgaaagtctggatttcagaataaagcagaatgtaagtttcagttgaggccatggatttgattgttccatggctggaagttccctttagatttcacattttatatggctgatcaattttcatacattgagaaaccaagtcaatcaagcaggaatcatttaaaaaccagataaagccatgtttttcttctgtgacaatttatcagtatctttaccaatgagccttaatttttatataggtccaatattgagcttttacttaaaatttagatagaacttttttttggatacagcacaaactccagttgacagtaaaatgaagcttctaggtattttgtattgtacatatttcctcctactgggtgttcaaaagaaatttaaattcaagtaccttttgtgataaaatgttttagatttgtgcacccattggcaaaacaggaaagtttccagataggtattgtatcattgagaatgcagcacagatagtgtgggcttcacactatagacacagaatatagctttttcttaaagccaaatttgggtgataggacactttaaatatccttaattttggcaaccactagcaaaaaaacttgtcagaataatttaaccaagcccctctccacttcttttatttaaaagcactgattcaattgctaggaatatttttgcagatttttctttacagtattccataggcaggtccactggaaaactgcagaaaaatgtgagctctcctggtaaatagtatacattttataagctatattttaaaggcctaagaacatggcaagtatttacttttatcttttttttaaaaacactcatgacagaaaacagtttaataatatctcattctaaaataaaacactggttgcagggtcttcaggatgcctattttgccaagaaacttcagtatacaggttagaaatatgcttttgtttttgaacaataatatactggtttgctttaaagaagggactaaatatgactttaaagagacttcaaaatattgagtattttaaaaatttaaaagtaggtcagtttataacgagtaaatacctaacacaccaagaatgtgcagtgaacctcaggcatttaagacacctcccccaccgcccgccccccgccccccccaatcaaagtgtggtcccaaaacaagccaacagctgtatatctcaaaagttaacccaagacaactctgatatttaggttatttgttgagactcattggtactgactggcaagtattctgctttaaagtatcatgtattaaaatgtttagacagcatgtgttttaaagtgataaatgcaaaatgttaagtttgaaatggttaacagtaaattattatgttagtttccaggcacttgaactgtgctacaagtaggggaaaacctactttaaagtatggtaaatgtgtgttttaaacttcctatcaagtgacatacttcatttgattttttgtttaagaagccatggtacttttttcttgagttactttggatatgttttttcaatgccatctgaagattttgtaattgagtagcagtaaatatacagatttacaatgttttaactacagttcatgaatagctggttgtgtaaaactaataaaaaactagactttcacatgt

SEQ ID NO: 16618 - DNA, 3878 bp, Homo sapiens
agtcctgtcggctcctcccaccccgggtcacgccgtgacaggggcggaagcggcggcggcggcggcggccgagaagaggctggggctcgcggcgcggctgcagccgtcctgtgcgcgcggcgcgcggctccggagaggcgcccgcagtccagggcggcgcgcaccgcctcgctggcgctcagagcggtgccttttccccgagactcccggcacctcttcagcgcaaagattatttaatgtaatggcaactccacgggggaggacaaagaaaaaagcatcttttgatcattctccggatagccttcctttgaggagctccggtaggcaggcgaagaagaaagcaacagagacaacagatgaggatgaagatggtggctcagagaagaagtacaggaaatgtgaaaaggcaggctgtacggcaacatgtcctgtgtgctttgcaagtgcttctgaaagatgtgccaaaaatggctacacctcccgatggtatcatctctcctgtggggaacatttctgtaatgaatgctttgaccattactacagaagccataaggatggatatgacaaatatactacatggaaaaaaatatggactagcaatggcaaaaccgaacctagtcccaaagctttcatggcagaccagcaactcccctactgggttcagtgtacaaaacctgagtgtagaaaatggaggcagcttaccaaggaaatccagcttactccacagatagccaagacttatcgatgcggtatgaaaccaaatactgctattaagcctgagacctcagatcattgttccctcccagaggatctagaagctcttactcctcagaaatgtattcctcacatcatcgtccggggtctcgtgcgtattcgatgcgttcaggaagtggagagaatactgtattttatgaccagaaaaggtctcatcaacactggagttctcagcgtgggagccgaccagtatcttctccctaaggactaccacaataaatcagtcatcattatcggggctggtccagcaggattagcagctgctaggcaactgcataactttggaattaaggtgactgtcctggaagccaaagacagaattggaggccgagtctgggatgataaatcttttaaaggcgtcacagtgggaagaggagctcagattgtcaatgggtgtattaacaacccagtagcattaatgtgtgaacaagtatctgctcgctcgtgggaccacaatgaattctttgcccagtttgctggtgaccacactctgctaactcccgggtactcggtgataattgaaaaactggcagaagggcttgacattcaactcaaatctccacaggtgcagtgtattgattattctggagatgaagtgcaggttaccactacagatggcacagggtattctgcacaaaaggtattagtcactgtaccactggctttactacagaaaggtgccattcagtttaatccaccgttgtcagagaagaagatgaaggctatcaacagcttaggcgcaggcatcattgaaaagattgccttgcaatttccgtatagattttgggacagtaaagtacaaggggctgacttttttggtcacgttcctcccagtgccagcaagcgagggctttttgccgtgttctatgacatggatccccagaagaagcacagcgtgctgatgtctgtgattgccggggaggctgtcgcatccgtgaggaccctggatgacaaacaggtgctgcagcagtgcatggccacgctccgggagctgttcaaggagcaggaggtcccagatcccacaaagtattttgtcactcggtggagcacagacccatggatccagatggcatacagttttgtgaagacaggtggaagtggggaggcctacgatatcattgctgaagacattcaaggaaccgtctttttcgctggtgaggcaacaaacaggcatttcccacaaactgttacaggggcatatttgagtggcgttcgagaagcaagcaagattgcagcattttaagaattcggtggacccagctttcttctgtaccccagatggggaaatttgaatcacatgttaaacctcagttttataagagggggaaaaaaccgtctctacatagtaaaactgaaatgtttctaaggcgatatgataatgcaaacctatttcatcactctaaaagcactgacctcaaaaaaccttataagcacttagatttaattgcattttccataggttcaactactgctgaaagtctggatttcagaataaagcagaatgtaagtttcagttgaggccatggatttgattgttccatggctggaagttccctttagatttcacattttatatggctgatcaattttcatacattgagaaaccaagtcaatcaagcaggaatcatttaaaaaccagataaagccatgtttttcttctgtgacaatttatcagtatctttaccaatgagccttaatttttatataggtccaatattgagcttttacttaaaatttagatagaacttttttttggatacagcacaaactccagttgacagtaaaatgaagcttctaggtattttgtattgtacatatttcctcctactgggtgttcaaaagaaatttaaattcaagtaccttttgtgataaaatgttttagatttgtgcacccattggcaaaacaggaaagtttccagataggtattgtatcattgagaatgcagcacagatagtgtgggcttcacactatagacacagaatatagctttttcttaaagccaaatttgggtgataggacactttaaatatccttaattttggcaaccactagcaaaaaaacttgtcagaataatttaaccaagcccctctccacttcttttatttaaaagcactgattcaattgctaggaatatttttgcagatttttctttacagtattccataggcaggtccactggaaaactgcagaaaaatgtgagctctcctggtaaatagtatacattttataagctatattttaaaggcctaagaacatggcaagtatttacttttatcttttttttaaaaacactcatgacagaaaacagtttaataatatctcattctaaaataaaacactggttgcagggtcttcaggatgcctattttgccaagaaacttcagtatacaggttagaaatatgcttttgtttttgaacaataatatactggtttgctttaaagaagggactaaatatgactttaaagagacttcaaaatattgagtattttaaaaatttaaaagtaggtcagtttataacgagtaaatacctaacacaccaagaatgtgcagtgaacctcaggcatttaagacacctcccccaccgcccgccccccgccccccccaatcaaagtgtggtcccaaaacaagccaacagctgtatatctcaaaagttaacccaagacaactctgatatttaggttatttgttgagactcattggtactgactggcaagtattctgctttaaagtatcatgtattaaaatgtttagacagcatgtgttttaaagtgataaatgcaaaatgttaagtttgaaatggttaacagtaaattattatgttagtttccaggcacttgaactgtgctacaagtaggggaaaacctactttaaagtatggtaaatgtgtgttttaaacttcctatcaagtgacatacttcatttgattttttgtttaagaagccatggtacttttttcttgagttactttggatatgttttttcaatgccatctgaagattttgtaattgagtagcagtaaatatacagatttacaatgttttaactacagttcatgaatagctggttgtgtaaaactaataaaaaactagactttcacatgt

SEQ ID NO: 16619 - DNA, 2045 bp, Homo sapiens
attgttccctcccagaggatctaagagtattggaagtttccaaccattggtggtactctatgctcatcctacctcctttgctgaaagacagtgtggcagcgcccctgctgtctgcctactaccctgactgtgttggcatgagcccctcctgcaccagcacaaaccgcgccgctgccactggcaatgccagccctgggaagctggagcactccaaggctgccctctccgtgcacgttccaggcatgaaccgatacttccagcctttctaccagcccaatgagtgtggcaaagccctctgtgtgaggccggatgtgatggaactggatgagctctatgagtttccagagtattcccgagaccccaccatgtacctggctttgagaaacctcatcctcgcactgtggtatactaactgcaaagaagctcttactcctcagaaatgtattcctcacatcatcgtccggggtctcgtgcgtattcgatgcgttcaggaagtggagagaatactgtattttatgaccagaaaaggtctcatcaacactggagttctcagcgtgggagccgaccagtatcttctccctaaggactaccacaataaatcagtcatcattatcggggctggtccagcaggattagcagctgctaggcaactgcataactttggaattaaggtgactgtcctggaagccaaagacagaattggaggccgagtctgggatgataaatcttttaaaggcgtcacagtgggaagaggagctcagattgtcaatgggtgtattaacaacccagtagcattaatgtgtgaacaacttggcatcagcatgcataaatttggagaaagatgtgacttaattcaggaaggtggaagaataactgaccccactattgacaagcgcatggattttcattttaatgctctcttggatgttgtctctgagtggagaaaggataagactcagctccaagatgtccctttaggagaaaagatagaagaaatctacaaggcatttattaaggaatctggtatccaattcagtgagctggagggacaggtgcttcagttccatctcagtaacctggagtacgcctgtggcagcaaccttcaccaggtatctgctcgctcgtgggaccacaatgaattctttgcccagtttgctggtgaccacactctgctaactcccgggtactcggtgataattgaaaaactggcagaagggcttgacattcaactcaaatctccacaggtgcagtgtattgattattctggagatgaagtgcaggttaccactacagatggcacagggtattctgcacaaaaggtattagtcactgtaccactggctttactacagaaaggtgccattcagtttaatccaccgttgtcagagaagaagatgaaggctatcaacagcttaggcgcaggcatcattgaaaagattgccttgcaatttccgtatagattttgggacagtaaagtacaaggggctgacttttttggtcacgttcctcccagtgccagcaagcgagggctttttgccgtgttctatgacatggatccccagaagaagcacagcgtgctgatgtctgtgattgccggggaggctgtcgcatccgtgaggaccctggatgacaaacaggtgctgcagcagtgcatggccacgctccgggagctgttcaaggagcaggaggtcccagatcccacaaagtattttgtcactcggtggagcacagacccatggatccagatggcatacagttttgtgaagacaggtggaagtggggaggcctacgatatcattgctgaagacattcaaggaaccgtctttttcgctggtgaggcaacaaacaggcatttcccacaaactgttacaggggcatatttgagtggcgttcgagaagcaagcaagattgcagcattttaagaattcggtggacccagctttcttctgtaccccagatggggaaatttgaatcacatgttaaacctcagttttataagagggggaaaaaaccgtctctacatagtaaaactgaaatgtttctaa

SEQ ID NO: 16620 - DNA, 495 bp, Homo sapiens
atgggcagggcggagcgagcgctgcggctaaagcgaaggcggggaccctacccatccctagtcctgtcggctcctcccaccccggaagaagcacagcgtgctgatgtctgtgattgccggggaggctgtcgcatccgtgaggaccctggatgacaaacaggtgctgcagcagtgcatggccacgctccgggagctgttcaaggagcaggaggtcccagatcccacaaagtattttgtcactcggtggagcacagacccatggatccagatggcatacagttttgtgaagacaggtggaagtggggaggcctacgatatcattgctgaagacattcaaggaaccgtctttttcgctggtgaggcaacaaacaggcatttcccacaaactgttacaggggcatatttgagtggcgttcgagaagcaagcaagattgcagcattttaagaattcggtggacccagctttcttctgtaccccagatggggaaatttgaa

SEQ ID NO: 16621 - DNA, 4884 bp, Homo sapiens
taatgggggtcgcccgggagtcggaagggggaggggaaagggaggaggcagccaaggaattgtttttttctctggccccgccctcgcccggggggccaatggtgatgatctgtttcccccggagcctcgcccagctcctgtgtttcagccaatgagcggcggaagcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttataaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcggcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcat

SEQ ID NO: 16622 - DNA, 4621 bp, Homo sapiens
ctcggctgcggggagaggggagagaaagggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttataaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcggcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataata

SEQ ID NO: 16623 - DNA, 4928 bp, Homo sapiens
actatcgctcctccctctagctgagtacgcctgaaaccgcacgttctcttccctgccctcccccgctaaccctgcaccgccctcaccctttcctgtgagattcttccgccaagtggaaggctcatcttcggtcgacagcctacgcggttgaagaacaatccacctcgcccagctcctgtgtttcagccaatgagcggcggaagcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttataaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcggcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataata

SEQ ID NO: 16624 - DNA, 565 bp, Homo sapiens
attttgtttttgtgtttttgcagggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttca

SEQ ID NO: 16625 - DNA, 8741 bp, Homo sapiens
gctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttataaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcggcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgagaaccgatttgattctcctccagcccctctacacagttaaatcaagtgtttttgttgatttgtgtttggcgggtttcttgaagcatgtggagacagagtctgtaaagaacagttactacaaatcagttatttgcaggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacaggtatttactgcttatgttaaattcaacatctcttgtaattgtcatttgtctgtttttcaaataacccaaggatttctatcagtgcatttgaaaggaacctggggatagctatcaagtggaaagagagagagaaagaattcatacagttcatgtgacagttcagagacccgttctgacttttcacattactttcgtagactctactgtggcctcttgtagtaggttttacatttttgtttcttgaagaagcacaaagttctaaagtagtctacctaataagtagctgtcgaatttgtaaagggtttaaaaaaattttttgtgtattttgcagaattaaaattattaagataagctttaacatttttaaaattactaaatatattttgcctgtgtttatgcagagttgaaggaaatgatgaaatgaacctttagttgcccatcacacaatgtaaaaaatgttaattttctcagtcctcatatgtctctccttggtggcatccctctcctccccaccatcacatgtacgtcttgctgtcccttctccccctcgttccagtaatcagtatgccgcattgtgtttaataatcagaaatttacatttctataaagctgtggtgtcataaggcaggatgggagagcagaagacttgtaatatttggagtcagaactgaatttgagttcttttccttccacgtgctagttgtgttactttggctgaagtgagctggtttctatgtgcttcagcttcctcatcagtaatatagaaataagaagcaatattgatgattgggcatcacagaattacatcacatgtaaagagagggcctggaccacaacaggggtttgaatattttttttcctccttcttatgtatgtataaactcactcttgccagtttttaaaattattttcttctacagcagtcatcttagatttaatttatgggttcttttaagagctcatcacatttttaaagctaagtcaaaatagcattttctctttctctgcatcccatttccttctgaaatcaccgctttacctttcctgcctgcgtcatttattcgtttttaaccatgttttctgtgcctatcctgaattctgggatgagttcataggggagacaggcacaaactggtcattttaaaccagcatggtacatagagtaatagggatatgtaccagcaggggctggtgaaagggtgcggggggtaataccttgctgtgtttaagttgctgacatctctcctaccttttagttattctctactagtgcgggattactgcagctgtggggatacccagggctaactattaggtggttttgttctggatatttatcttacttgttggtcggctattaggagagaagaaaagaaaaggaagctgtcattcttcagcttatgtaaaatcgtcctttaatgcttaacacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcaggtaatgtaggcctcccatcctcctgccctattcagaacccccttctcagttcctttagcagacttctgacaaccccaccccaggctttccccctccttcacctcctgttttattctttattgtttcaggtgaatataatcaggtcaggatgtggccatgggtcttactttttaaagcagatggtcctaagctggacttttccagtcaggtttttgttgcttcctaccagtccctgttgggtttttgacgagggcatccaggcttggtgattcctatggtaaacttcagcagaggaagtgagggtgtgactacaggctgatgggatttgggagatcagacaaaatgtgctacaaaatcatgcacccctcttacctgaatgaaaagcctgtgctgaaggcagttctaggtgggctagggccgcgtggtgtcacatagtccccaggtgcctgcttcaaagggcagtgttgttggatcttaagtgccggttaatatctttaggagaatttctaggcctgcttctgtgctttcttgttttggttctgttttctggatctctggcttctctgtttggccagatagggtctttgctaaaggaacactctgctcttggacaagaatttgggagaattgccaaacagaaagatgtgagtgtttaaccaaaaataaatttccaaaatgtttttctccatccagtgtactaataggatttgctcatttaatcatatatagacaagaaacaaaatgatgggctgaatacagtttatcggcaggctttctttcttgcttgtcaatattttaatgttagactatttcacataaaggttagagcttctgggttgtcttagacggccaaaagatttggcaccctcacacagccagtagtagtgaggggtgtcacaggccatattcctgcttggcaataacaggctcaagtacggtggggtcagtcaccctgtttcactggtgactggtgtcactggacactccttccagcgcttgtcttcttcacagtccgtcttgctgtaagtaatgagatcttactaggagaggtgatcctttctcctagatgcttacccatgtagtttgagagcaagggtgtgtagcagatgaatggtgaaggttggaggtgctttgggagctcagagaactaagccgaaactgtcacatcaccatctgagacggagcaccagctccatggaaatataccaatagcagtgtgaagagggactgccttcgggagtggggacagagctggcagagttcagactaaagttttccttctcttcatttagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtgtgctgcttatggcatgtgtgaacagaggcataaggaatagcaatattatgttactacatgtggtgaactgactggcttggctaggggaattgtcacaacctgaaaagttaaatctgtacctgtcagattgaataggctgaaggtggttgctaaggaacaaggattctaaatgattagggttacacttctaaaaaaagcaggccttgtcttttatgtctgtgttttgtgttagagtgcatttagagatttttgttctctgctttcaagttagaagttagttcatctgatcatctcccagcatatatctgtttttattgccttgagaatctgagcacttcagacgttcatgtatccttggccctgagtgaccatgttctgagtgagttgctaagtttggttttgtccactgtcatgtagcaagtggtcctacttgttactagcaagggttgcagggatttggaagattctaggtttcccctgtagttggcaggtttttttttcagcaagggctatgtgtggaaattctaggcaactagaaagatgagtcgtgttcagttttaaaattgtttggcactgaggctgccggttgcaactcaggtgtctttggctgatattcttcagtcattcatgagtcttggatatgaacattcgtaacctgttagctggccccaagtatgtctttaacaagcatttgtttgaatcaaagtgtttctggctaaggatcatttggctcttccagaaaaccggcttggtcaccatattgttcttttgatattgtcactctgagtctctgctttaccagttactggatcaaggataaacaagtctaatctgcagctgtctttgggactgtttcgtaagtcagattaagtaaaggcaggtttctaataactttaaaacaagttcatttataaggatactgagcctacttatgtttaaaaatctagactaaaatattgtttaaatacagtatttacaaacttatgcagagcctgtcagtcatggtttatgggaactgacatcacattttcttcgtcattcttctgttggttcattcagctgaagtctttgatactactagtcgtcttctgccaatgggggcacttaagttgaagaaggcctgacatttatgaactgccaacactgtttagaggaaaaaaatggcttattgggccttagcatgttactgagttgcataatattttgaatgtattctaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataa

SEQ ID NO: 16626 - DNA, 709 bp, Homo sapiens
attatccagtaactccacgcctttcttcatttatccttcaaaatggcggactttagacgttccacgatcagtaccacgtgcgcctgcgcctcccgcagccatttcgcccagcagcctaagctcggcgaggcgcctgcgcacgagcctccagagcactatcgctcctccctctagctgagtacgcctgaaaccgcacgttctcttccctgccctcccccgctaaccctgcaccgccctcaccctttcctgtgagattcttccgccaagtggaaggctcatcttcggtcgacagcctacgcggttgaagaacaatccaggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggac

SEQ ID NO: 16627 - DNA, 4880 bp, Homo sapiens
taatgggggtcgcccgggagtcggaagggggaggggaaagggaggaggcagccaaggaattgtttttttctctggccccgccctcgcccggggggccaatggtgatgatctgtttcccccggagcctcgcccagctcctgtgtttcagccaatgagcggcggaagcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttataaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcggcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcat

SEQ ID NO: 16628 - DNA, 3903 bp, Homo sapiens
atggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaagacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttataaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcggcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttc

SEQ ID NO: 16629 - DNA, 6813 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttatcgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcagcgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggtggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtggaaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttacttttttttttttttttaaataaaagtcatttaatgtagaatacttttaatttcactttctgtattttaattttgttgaagggctgattgggatttccatgttcttattaaaaatctaacaaatctg

SEQ ID NO: 16630 - DNA, 5581 bp, Homo sapiens
atgggagcgatggagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggtggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtggaaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttacttttttttttttttttaaataaaagtcatttaatgtagaatacttttaatttcactttctgtattttaattttgttgaagggctgattgggatttccatgttcttattaaaaatctaacaaatctg

SEQ ID NO: 16631 - DNA, 3034 bp, Homo sapiens
gtgccagaaaaacagaaaggcagccggtcgcaggcctcgggagagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggtggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttct

SEQ ID NO: 16632 - DNA, 5983 bp, Homo sapiens
ggctggaggtggctctatggtgttgtgagccatcaggactccatcactcgtcttatggaggtgtctgtaactgagagtggtgagatcaagtcggtagatcccagactaatccatgtgatgctgatggataattcagcgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggtggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtggaaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttacttttttttttttttttaaataaaagtcatttaatgtagaatacttttaatttcactttctgtattttaattttgttgaagggctgattgggatttccatgttcttattaaaaatctaacaaatctg

SEQ ID NO: 16633 - DNA, 9692 bp, Homo sapiens
gcagaactttggcgggcaaggagacaaacagccacactgtgctgccggggaagagaagaagaaggaaaggccagacacacaggcgtcgtgcagctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggacccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttcaccccttctcacttgtatgttctgtaaagtgtatttctactttggtaggaagaaagacttgatttaatatttc

SEQ ID NO: 16634 - DNA, 5274 bp, Homo sapiens
gcagaactttggcgggcaaggagacaaacagccacactgtgctgccggggaagagaagaagaaggaaaggccagacacacaggcgtcgtgcagctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggacccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaagggagttgtatttgtaacggaagaagagaagaataaaaaatattag

SEQ ID NO: 16635 - DNA, 10712 bp, Homo sapiens
gcagaactttggcgggcaaggagacaaacagccacactgtgctgccggggaagagaagaagaaggaaaggccagacacacaggcgtcgtgcagctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggacccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttcaccccttctcacttgtatgttctgtaaagtgtatttctactttggtaggaagaaagacttgatttaatatttc

SEQ ID NO: 16636 - DNA, 10763 bp, Homo sapiens
gcagaactttggcgggcaaggagacaaacagccacactgtgctgccggggaagagaagaagaaggaaaggccagacacacaggcgtcgtgcagctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggacccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttca

SEQ ID NO: 16637 - DNA, 4418 bp, Homo sapiens
acactcccggcttcttctggctcagccgctcggctccccggggaggcctgggctgtgctggtggggatggggtccgggcgaggccgtgtttgtaggggaacgtcagacggagagacctccgaagatttcgtgctcgtttcccccggccctcaggctccgggcactgaaaggcagtcacccaccgcagcccttccagccctgtctacagcgcctcgggcctgggggcagtgagtgaggggtgggtgttgctgaaaccatccgtaacggctccaacgttcgctgaggagagcccggccaactccttcctccgtggccggaactgggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacggaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccacgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttacaaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatccccgtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggaccccc

SEQ ID NO: 16638 - DNA, 6449 bp, Homo sapiens
caactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagagagacagagtctcgctgtgttgcccaggctggagtgcagtggcgcgatcttggctcactgcaacctccgcctcctagattccagcaattcttctgcctcagcctcccaagccatgaatattaaaatagaacccgaggagacaacggaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccacgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttacaaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatccccgtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctcccc

SEQ ID NO: 16639 - DNA, 7438 bp, Homo sapiens
ttcagtctgttgaaggataccccgttgtgtatttctacctgtatgtaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttcgcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacggaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccacgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttacaaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatccccgtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatgacttcta

SEQ ID NO: 16640 - DNA, 7396 bp, Homo sapiens
tacctgtatgtaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttcgcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacggaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccacgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttacaaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatccccgtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatg

SEQ ID NO: 16641 - DNA, 2513 bp, Homo sapiens
tttgctgaggctgttaacttctgcactgttgattggctgccattaggccgacagtgtgtggagcattatcgcttgcttcatcgatattgtgtgttttcccacgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttacaaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagagtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatccccgtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggaccccc

SEQ ID NO: 16642 - DNA, 5245 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccc

SEQ ID NO: 16643 - DNA, 5122 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagagattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccc

SEQ ID NO: 16644 - DNA, 6031 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtaggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtt

SEQ ID NO: 16645 - DNA, 5677 bp, Homo sapiens
ggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtaggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaa

SEQ ID NO: 16646 - DNA, 6096 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcgattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcagatctggagctgctgtcctcgctgttgccacagttgactggccctgtgttggaactgcctgaggcaacccgggcccccttggaggagctcatgatggagggggacctgctcgaggtgaccctggatgagaaccacagcatccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatctactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtga

SEQ ID NO: 16647 - DNA, 5472 bp, Homo sapiens
cggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcttatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttggatactatgaa

SEQ ID NO: 16648 - DNA, 5134 bp, Homo sapiens
aaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcttatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttggatact

SEQ ID NO: 16649 - DNA, 880 bp, Homo sapiens
ctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgacc

SEQ ID NO: 16650 - DNA, 4701 bp, Homo sapiens
cggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggct

SEQ ID NO: 16651 - DNA, 1336 bp, Homo sapiens
ggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccag

SEQ ID NO: 16652 - DNA, 2894 bp, Homo sapiens
ctgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggttctttcctggaagtggcggagatatgtgttcccataccatctctgtgtgtacagcatgcaaggaaatatccttccagactgaaataattaaaaactctaaactgggcctacataagacactggctcttgggaatggggtggagaggactgattggttggttggttgatttccctccagacaccagagtcttagaaagcttactagatggataagattgtattaaagtgggtttgg

SEQ ID NO: 16653 - DNA, 5579 bp, Homo sapiens
cattttaaaaaagatccggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaagagacaaagtctcactgtgttgaccaggctgatctcaagcttctgggctcaagcagtcctcccaccttggcctcccaaagtgttgggattacaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcttatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttggatactatg

SEQ ID NO: 16654 - DNA, 5924 bp, Homo sapiens
gtgacacaattacaacaactttgtgctggtgccggggaagtttgtgtctccaacgaatcccctcagtgctccccagccccgcgcgctccggccgttcccgccgtccccgcctgtggctgccccctgcccaaccccgcgatgtgaccctacagccgaaagccgccgctgccgacccgggggctccgcagcccctgccgccgccgccgccgccttcaccgccgccgcgttgggatttttcgtcgccgccgcccgcggcggaggaggaggcggcgataaagttggtgtgctggtcccgcgcgcagattgggggcgtcactgcgggccccggtccgagggggggtgtcggcgttggagttgtgaattcgctgcgtttccatgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggctcagttgtgtaaccttccacaaggtagtctacagaataaaactaaattacttcctagtattgaggaggcgtggagcctaccaattcccgcagagcttacctccaggcagggtgccatgaacacagcacagcaggcatgtaaacctcatcatccaaatactgaacctgtattaggcctcagtcaaacaccaatttcacagcaatccttgccactacacatgattccttctagccaagtagatgacctgtccagtcctgccaagaggaaaagaacatctagtccaacaaagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgcc

SEQ ID NO: 16655 - DNA, 5438 bp, Homo sapiens
ggggggtgtcggcgttggagttgtgaattcgctgcgtttccatgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggctcagttgtgtaaccttccacaaggtagtctacagaataaaactaaattacttcctagtattgaggaggcgtggagcctaccaattcccgcagagcttacctccaggcagggtgccatgaacacagcacagcagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgccaaaa

SEQ ID NO: 16656 - DNA, 4337 bp, Homo sapiens
gaattcgctgcgtttccatgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggcatgtaaacctcatcatccaaatactgaacctgtattaggcctcagtcaaacaccaatttcacagcaatccttgccactacacatgattccttctagccaagtagatgacctgtccagtcctgccaagaggaaaagaacatctagtccaacaaagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggct

SEQ ID NO: 16657 - DNA, 4189 bp, Homo sapiens
aggcactctctatgaatcctgcaaccagcctcaggatgccattaaatgctacttaaatgcaactagaagcaaaagttgtagtaatacctctgcacttgcagcacgaattaagtatttacagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgccaaaa

SEQ ID NO: 16658 - DNA, 735 bp, Homo sapiens
ggcacgaaatatcaaggtctcagatccaaagctttttgaaatgattaagatattttcattgtctccgaattttagagctgaaaagtgccttagagatcatctagttcaacctctccgttcaaatggagaacctgagccactaagattcacaggagagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaa

SEQ ID NO: 16659 - DNA, 4324 bp, Homo sapiens
gaataaaactaaattacttcctagtattgaggaggcgtggagcctaccaattcccgcagagcttacctccaggcagggtgccatgaacacagcacagcaggcatgtaaacctcatcatccaaatactgaacctgtattaggcctcagtcaaacaccaatttcacagcaatccttgccactacacatgattccttctagccaagtagatgacctgtccagtcctgccaagaggaaaagaacatctagtccaacaaagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgccaaaa

SEQ ID NO: 16660 - DNA, 671 bp, Homo sapiens
ctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggctcagttgtgtaaccttccacaaggtagtctacagaataaaactaaattacttcctagtattgaggaggcgtggagcctaccaattcccgcagagcttacctccaggcagggtgccatgaacacagcacagcagaatacttctgacaattggagtggtggacatgctgtgtcacatcctccagtacagcaacaagctcattcatggtgtttgacaccacagaaattacagatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggc

SEQ ID NO: 16661 - DNA, 1918 bp, Homo sapiens
agtctacagaataaaactaaattacttcctagtattgaggaggcgtggagcctaccaattcccgcagagcttacctccaggcagggtgccatgaacacagcacagcagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattg

SEQ ID NO: 16662 - DNA, 4185 bp, Homo sapiens
gaattcgctgcgtttccatgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctg

SEQ ID NO: 16663 - DNA, 2876 bp, Homo sapiens
atgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcaatttcacattgcccacttatatgaaacccaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacagaatacttctgacaattggagtggtggacatgctgtgtcacatcctccagtacagcaacaagctcattcatggtgtttgacaccacagaaattacagatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttga

SEQ ID NO: 16664 - DNA, 3969 bp, Homo sapiens
atgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacagaatacttctgacaattggagtggtggacatgctgtgtcacatcctccagtacagcaacaagctcattcatggtgtttgacaccacagaaattacagatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttga

SEQ ID NO: 16665 - DNA, 6705 bp, Homo sapiens
aggttccccccagggcaacatgccagccccgtagcactgcccaccccacccactgtggtctgttgtaccccactgctggggtggtggttccaatgagacagggcacaccaaactccatctggctgttactgaggcggagacacgggtgatgattggctttctggggagagaggaagtcctgtgattggccagatctctggagcttgccgacgcggtgtgaggacgctcccacggaggccggaattggctgtgaaaggactgaggcagccatctgggggtagcgggcactcttatcagagcggctggagccggaccatcgtcccagagagctggggcagggggccgtgcccaatctccagggctcctggggccactgctgacctggctggatgcatcgggcagtggaccctccaggggcccgcgctgcacgggaagcctttgcccttgggggcctgagctgtgctggggcctggagctcctgcccgcctcatccccctcctcgtagcgcatggctgcctggaggcagatgctcagccagcattgggcagcccccgcttcctgctcccctacccccttcacatggcagtagttctgggcaccccagcaaaccatattatgctccaggggcgcccactccaagacccctccatgggaagctggaatccctgcatggctgtgtgcaggcattgctccgggagccagcccagccagggctttgggaacagcttgggcaactgtacgagtcagagcacgatagtgaggaggccacacgctgctaccacagcgcccttcgatacggaggaagcttcgctgagctggggccccgcattggccgactgcagcaggcccagctctggaactttcatactggctcctgccagcaccgagccaaggtcctgcccccactggagcaagtgtggaacttgctacaccttgagcacaaacggaactatggagccaagcggggaggtcccccggtgaagcgagctgctgaacccccagtggtgcagcctgtgcctcctgcagcactctcaggcccctcaggggaggagggcctcagccctggaggcaagcgaaggagaggctgcaactctgaacagactggccttcccccagggctgccactgcctccaccaccattaccaccaccaccaccaccaccaccaccaccaccaccacccctgcctggcctggctaccagccccccatttcagctaaccaagccagggctgtggagtaccctgcatggagatgcctggggcccagagcgcaagggttcagcacccccagagcgccaggagcagcggcactcgctgcctcacccatatccatacccagctccagcgtacaccgcgcacccccctggccaccggctggtcccggctgctcccccaggcccaggcccccgccccccaggagcagagagccatggctgcctgcctgccacccgtccccccggaagtgaccttagagagagcagagttcagaggtcgcggatggactccagcgtttcaccagcagcaaccaccgcctgcgtgccttacgccccttcccggccccctggcctccccggcaccaccaccagcagcagcagtagcagcagcagcaacactggtctccggggcgtggagccgaacccaggcattcccggcgctgaccattaccaaactcccgcgctggaggtctctcaccatggccgcctggggccctcggcacacagcagtcggaaaccgttcttgggggctcccgctgccactccccacctatccctgccacctggaccttcctcaccccctccacccccctgtccccgcctcttacgccccccaccaccccctgcctggttgaagggtccggcctgccgggcagcccgagaggatggagagatcttagaagagctcttctttgggactgagggacccccccgccctgccccaccacccctcccccatcgcgagggcttcttggggcctccggcctcccgcttttctgtgggcactcaggattctcacacccctcccactcccccaaccccaaccaccagcagtagcaacagcaacagtggcagccacagcagcagccctgctgggcctgtgtcctttcccccaccaccctatctggccagaagtatagacccccttccccggcctcccagcccagcacagaacccccaggacccacctcttgtacccctgactcttgccctgcctccagcccctccttcctcctgccaccaaaatacctcaggaagcttcaggcgcccggagagcccccggcccagggtctccttcccaaagacccccgaggtggggccggggccacccccaggccccctgagtaaagccccccagcctgtgccgcccggggttggggagctgcctgcccgaggccctcgactctttgattttccccccactccgctggaggaccagtttgaggagccagccgaattcaagatcctacctgatgggctggccaacatcatgaagatgctggacgaatccattcgcaaggaagaggaacagcaacaacacgaagcaggcgtggccccccaacccccgctgaaggagccctttgcatctctgcagtctcctttccccaccgacacagcccccaccactactgctcctgctgtcgccgtcaccaccaccaccaccaccaccaccaccaccacggccacccaggaagaggagaagaagccaccaccagccctaccaccaccaccgcctctagccaagttccctccaccctctcagccacagccaccaccacccccaccccccagcccggccagcctgctcaaatccttggcctccgtgctggagggacaaaagtactgttatcgggggactggagcagctgtttccacccggcctgggcccttgcccaccactcagtattcccctggccccccatcaggtgctaccgccctgccgcccacctcagcggcccctagcgcccagggctccccacagccctctgcttcctcgtcatctcagttctctacctcaggcgggccctgggcccgggagcgcagggcgggcgaagagccagtcccgggccccatgacccccacccaaccgcccccacccctatctctgccccctgctcgctctgagtctgaggtgctagaagagatcagccgggcttgcgagacccttgtggagcgggtgggccggagtgccactgacccagccgacccagtggacacagcagagccagcggacagtgggactgagcgactgctgccccccgcacaggccaaggaggaggctggcggggtggcggcagtgtcaggcagctgtaagcggcgacagaaggagcatcagaaggagcatcggcggcacaggcgggcctgtaaggacagtgtgggtcgtcggccccgtgagggcagggcaaaggccaaggccaaggtccccaaagaaaagagccgccgggtgctggggaacctggacctgcagagcgaggagatccagggtcgtgagaagtcccggcccgatcttggcggggcctccaaggccaagccacccacagctccagcccctccatcagctcctgcaccttctgcccagcccacacccccgtcagcctctgtccctggaaagaaggctcgggaggaagccccagggccaccgggtgtcagccgggccgacatgctgaagctgcgctcacttagtgaggggccccccaaggagctgaagatccggctcatcaaggtagagagtggtgacaaggagacctttatcgcctctgaggtggaagagcggcggctgcgcatggcagacctcaccatcagccactgtgctgctgacgtcgtgcgcgccagcaggaatgccaaggtgaaagggaagtttcgagagtcctacctttcccctgcccagtctgtgaaaccgaagatcaacactgaggagaagctgccccgggaaaaactcaacccccctacacccagcatctatctggagagcaaacgggatgccttctcacctgtcctgctgcagttctgtacagaccctcgaaatcccatcacagtgatccggggcctggcgggctccctgcggctcaacttgggcctcttctccaccaagaccctggtggaagcgagtggcgaacacaccgtggaagttcgcacccaggtgcagcagccctcagatgagaactgggatctgacaggcactcggcagatctggccttgtgagagctcccgttcccacaccaccattgccaagtacgcacagtaccaggcctcatccttccaggagtctctgcaggaggagaaggagagtgaggatgaggagtcagaggagccagacagcaccactggaacccctcctagcagcgcaccagacccgaagaaccatcacatcatcaagtttggcaccaacatcgacttgtctgatgctaagcggtggaagccccagctgcaggagctgctgaagctgcccgccttcatgcgggtaacatccacgggcaacatgctgagccacgtgggccacaccatcctgggcatgaacacggtgcagctgtacatgaaggtgcccggcagccgaacgccaggccaccaggagaataacaacttctgctccgtcaacatcaacattggcccaggcgactgcgagtggttcgcggtgcacgagcactactgggagaccatcagcgctttctgtgatcggcacggcgtggactacttgacgggttcctggtggccaatcctggatgatctctatgcatccaatattcctgtgtaccgcttcgtgcagcgacccggagacctcgtgtggattaatgcggggactgtgcactgggtgcaggccaccggctggtgcaacaacattgcctggaacgtggggcccctcaccgcctatcagtaccagctggccctggaacgatacgagtggaatgaggtgaagaacgtcaaatccatcgtgcccatgattcacgtgtcatggaacgtggctcgcacggtcaaaatcagcgaccccgacttgttcaagatgatcaagttctgcctgctgcagtccatgaagcactgccaggtgcaacgcgagagcctggtgcgggcagggaagaaaatcgcttaccagggccgtgtcaaggacgagccagcctactactgcaacgagtgcgatgtggaggtgtttaacatcctgttcgtgacaagtgagaatggcagccgcaacacgtacctggtacactgcgagggctgtgcccggcgccgcagcgcaggcctgcagggcgtggtggtgctggagcagtaccgcactgaggagctggctcaggcctacgacgccttcacgctggtgagggcccggcgggcgcgcgggcagcggaggagggcactggggcaggctgcagggacgggcttcgggagcccggccgcgcctttccctgagcccccgccggctttctccccccaggccccagccagcacgtcgcgatgaggccggacgccccgcccgcctgcctgcccgcgcaaggcgccgcggggccaccagcacatgcctgggctggacctaggtcccgcctgtggccgagaagggggtcgggcccagcccttccaccccattggcagctcccctcacttaatttattaagaaaaactttttttttttttttagcaaatatgaggaaaaaaggaaaaaaaatgggagacgggggagggggctggcagcccctcgcccaccagcgcctcccctcaccgactttggcctttttagcaacagacacaaggaccaggctccggcggcggcgggggtcacatacgggttccctcaccctgccagccgcccgcccgcccggcgcagatgcacgcggctcgtgtatgtacatagacgttacggcagccgaggtttttaatgagattctttctatgggctttacccctcccccggaacctccttttttacttccaatgctagctgtgacccctgtacatgtctctttattcacttggttatgatttgtattttttgttcttttcttgtttttttgtttttaatttataacagtcccactcacctctatttattcatttttgggaaaacccgacctcccacacccccaagccatcctgcccgcccctccagggaccgcccgtcgccgggctctccccgcgccccagtgtgtgtccgggcccggcccgaccgtctccacccgtccgcccgcggctccagccgggttctcatggtgctcaaacccgctcccctcccctacgtcctgcactttctcggaccagtccccccactcccgacccgaccccagccccacctgagggtgagcaactcctgtactgtaggggaagaagtgggaactgaaatggtattttgtaaaaaaaataaataaaataaaaaaattaaaggttttaaagaaagaactatgaggaaaaggaaccccgtccttcccagccccggccaactttaaaaaacacagaccttcacccccacccccttttctttttaagtgtgaaacaacccagggccagggcctcactggggcagggacaccccggggtgagtttctctggggctttattttcgttttgttggttgttttttctccacgctggggctgcggaggggtggggggtttacagtcccgcaccctcgcactgcactgtctctctgccccaggggcagaggggtcttcccaaccctacccctattttcggtgatttttgtgtgagaatattaatattaaaaataaacggag

SEQ ID NO: 16666 - DNA, 5321 bp, Homo sapiens
aggttccccccagggcaacatgccagccccgtagcactgcccaccccacccactgtggtctgttgtaccccactgctggggtggtggttccaatgagacagggcacaccaaactccatctggctgttactgaggcggagacacgggtgatgattggctttctggggagagaggaagtcctgtgattggccagatctctggagcttgccgacgcggtgtgaggacgctcccacggaggccggaattggctgtgaaaggactgaggcagccatctgggggtagcgggcactcttatcagagcggctggagccggaccatcgtcccagagagctggggcagggggccgtgcccaatctccagggctcctggggccactgctgacctggctggatgcatcgggcagtggaccctccaggggcccgcgctgcacgggaagcctttgcccttgggggcctgagctgtgctggggcctggagctcctgcccgcctcatccccctcctcgtagcgcatggctgcctggaggcagatgctcagccagcattgggcagcccccgcttcctgctcccctacccccttcacatggcagtagttctgggcaccccagcaaaccatattatgctccaggggcgcccactccaagacccctccatgggaagctggaatccctgcatggctgtgtgcaggcattgctccgggagccagcccagccagggctttgggaacagcttgggcaactgtacgagtcagagcacgatagtgaggaggccacacgctgctaccacagcgcccttcgatacggaggaagcttcgctgagctggggccccgcattggccgactgcagcaggcccagctctggaactttcatactggctcctgccagcaccgagccaaggtcctgcccccactggagcaagtgtggaacttgctacaccttgagcacaaacggaactatggagccaagcggggaggtcccccggtgaagcgagctgctgaacccccagtggtgcagcctgtgcctcctgcagcactctcaggcccctcaggggaggagggcctcagccctggaggcaagcgaaggagaggctgcaactctgaacagactggccttcccccagggctgccactgcctccaccaccattaccaccaccaccaccaccaccaccaccaccaccaccacccctgcctggcctggctaccagccccccatttcagctaaccaagccagggctgtggagtaccctgcatggagatgcctggggcccagagcgcaagggttcagcacccccagagcgccaggagcagcggcactcgctgcctcacccatatccatacccagctccagcgtacaccgcgcacccccctggccaccggctggtcccggctgctcccccaggcccaggcccccgccccccaggagcagagagccatggctgcctgcctgccacccgtccccccggaagtgaccttagagagagcagagttcagaggtcgcggatggactccagcgtttcaccagcagcaaccaccgcctgcgtgccttacgccccttcccggccccctggcctccccggcaccaccaccagcagcagcagtagcagcagcagcaacactggtctccggggcgtggagccgaacccaggcattcccggcgctgaccattaccaaactcccgcgctggaggtctctcaccatggccgcctggggccctcggcacacagcagtcggaaaccgttcttgggggctcccgctgccactccccacctatccctgccacctggaccttcctcaccccctccacccccctgtccccgcctcttacgccccccaccaccccctgcctggttgaagggtccggcctgccgggcagcccgagaggatggagagatcttagaagagctcttctttgggactgagggacccccccgccctgccccaccacccctcccccatcgcgagggcttcttggggcctccggcctcccgcttttctgtgggcactcaggattctcacacccctcccactcccccaaccccaaccaccagcagtagcaacagcaacagtggcagccacagcagcagccctgctgggcctgtgtcctttcccccaccaccctatctggccagaagtatagacccccttccccggcctcccagcccagcacagaacccccaggacccacctcttgtacccctgactcttgccctgcctccagcccctccttcctcctgccaccaaaatacctcaggaagcttcaggcgcccggagagcccccggcccagggtctccttcccaaagacccccgaggtggggccggggccacccccaggccccctgagtaaagccccccagcctgtgccgcccggggttggggagctgcctgcccgaggccctcgactctttgattttccccccactccgctggaggaccagtttgaggagccagccgaattcaagatcctacctgatgggctggccaacatcatgaagatgctggacgaatccattcgcaaggaagaggaacagcaacaacacgaagcaggcgtggccccccaacccccgctgaaggagccctttgcatctctgcagtctcctttccccaccgacacagcccccaccactactgctcctgctgtcgccgtcaccaccaccaccaccaccaccaccaccaccacggccacccaggaagaggagaagaagccaccaccagccctaccaccaccaccgcctctagccaagttccctccaccctctcagccacagccaccaccacccccaccccccagcccggccagcctgctcaaatccttggcctccgtgctggagggacaaaagtactgttatcgggggactggagcagctgtttccacccggcctgggcccttgcccaccactcagtattcccctggccccccatcaggtgctaccgccctgccgcccacctcagcggcccctagcgcccagggctccccacagccctctgcttcctcgtcatctcagttctctacctcaggcgggccctgggcccgggagcgcagggcgggcgaagagccagtcccgggccccatgacccccacccaaccgcccccacccctatctctgccccctgctcgctctgagtctgaggtgctagaagagatcagccgggcttgcgagacccttgtggagcgggtgggccggagtgccactgacccagccgacccagtggacacagcagagccagcggacagtgggactgagcgactgctgccccccgcacaggccaaggaggaggctggcggggtggcggcagtgtcaggcagctgtaagcggcgacagaaggagcatcagaaggagcatcggcggcacaggcgggcctgtaaggacagtgtgggtcgtcggccccgtgagggcagggcaaaggccaaggccaaggtccccaaagaaaagagccgccgggtgctggggaacctggacctgcagagcgaggagatccagggtcgtgagaagtcccggcccgatcttggcggggcctccaaggccaagccacccacagctccagcccctccatcagctcctgcaccttctgcccagcccacacccccgtcagcctctgtccctggaaagaaggctcgggaggaagccccagggccaccgggtgtcagccgggccgacatgctgaagctgcgctcacttagtgaggggccccccaaggagctgaagatccggctcatcaaggtagagagtggtgacaaggagacctttatcgcctctgaggtggaagagcggcggctgcgcatggcagacctcaccatcagccactgtgctgctgacgtcgtgcgcgccagcaggaatgccaaggtgaaagggaagtttcgagagtcctacctttcccctgcccagtctgtgaaaccgaagatcaacactgaggagaagctgccccgggaaaaactcaacccccctacacccagcatctatctggagagcaaacgggatgccttctcacctgtcctgctgcagttctgtacagaccctcgaaatcccatcacagtgatccggggcctggcgggctccctgcggctcaacttgggcctcttctccaccaagaccctggtggaagcgagtggcgaacacaccgtggaagttcgcacccaggtgcagcagccctcagatgagaactgggatctgacaggcactcggcagatctggccttgtgagagctcccgttcccacaccaccattgccaagtacgcacagtaccaggcctcatccttccaggagtctctgcaggaggagaaggagagtgaggatgaggagtcagaggagccagacagcaccactggaacccctcctagcagcgcaccagacccgaagaaccatcacatcatcaagtttggcaccaacatcgacttgtctgatgctaagcggtggaagccccagctgcaggagctgctgaagctgcccgccttcatgcgggtaacatccacgggcaacatgctgagccacgtgggccacaccatcctgggcatgaacacggtgcagctgtacatgaaggtgcccggcagccgaacgccaggccaccaggagaataacaacttctgctccgtcaacatcaacattggcccaggcgactgcgagtggttcgcggtgcacgagcactactgggagaccatcagcgctttctgtgatcggcacggcgtggactacttgacgggttcctggtggccaatcctggatgatctctatgcatccaatattcctgtgtaccgcttcgtgcagcgacccggagacctcgtgtggattaatgcggggactgtgcactgggtgcaggccaccggctggtgcaacaacattgcctggaacgtggggcccctcaccgcctatcagtaccagctggccctggaacgatacgagtggaatgaggtgaagaacgtcaaatccatcgtgcccatgattcacgtgtcatggaacgtggctcgcacggtcaaaatcagcgaccccgacttgttcaagatgatcaagttctgcctgctgcagtccatgaagcactgccaggtgcaacgcgagagcctggtgcgggcagggaagaaaatcgcttaccagggccgtgtcaaggacgagccagcctactactgcaacgagtgcgatgtggaggtgtttaacatcctgttcgtgacaagtgagaatggcagccgcaacacgtacctggtacactgcgagggctgtgcccggcgccgcagcgcaggcctgcagggcgtggtggtgctggagcagtaccgcactgaggagctggctcaggcctacgacgccttcacgctggccccagccagcacgtcgcgatga

SEQ ID NO: 16667 - DNA, 5060 bp, Homo sapiens
ggccggacgcctccgcgttacgggatgaattaacggcgggttccgcacggaggttgtgacccctacggagccccagcttgcccacgcaccccactcggcgtcgcgcggcgtgccctgcttgtcacaggtgggaggctggaactatcaggctgaaaaacagagtgggtactctcttctgggaagctggcaacaaatggatgatgtgatatatgcattccaggggaagggaaattgtggtgcttctgaacccatggtcaattaacgaggcagtttctagctactgcacgtacttcataaagcaggactctaaaagctttggaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggttgggccatgcaggctgctgcctatatcttcattcataggaaatggaaggatgacaagagccatttcgaagacatgattgattacttttgtgatattcacgaaccacttcaactcctcatattcccagaagggactgatctcacagaaaacagcaagtctcgaagtaatgcatttgctgaaaaaaatggacttcagaaatatgaatatgttttacatccaagaactacaggctttacttttgtggtagaccgtctaagagaaggtaagaaccttgatgctgtccatgatatcactgtggcgtatcctcacaacattcctcaatcagagaagcacctcctccaaggagactttcccagggaaatccactttcacgtccaccggtatccaatagacaccctccccacatccaaggaggaccttcaactctggtgccacaaacggtgggaagagaaagaagagaggctgcgttccttctatcaaggggagaagaatttttattttaccggacagagtgtcattccaccttgcaagtctgaactcagggtccttgtggtcaaattgctctctatactgtattggaccctgttcagccctgcaatgtgcctactcatatatttgtacagtcttgttaagtggtattttataatcaccattgtaatctttgtgctgcaagagagaatatttggtggactggagatcatagaacttgcatgttaccgacttttacacaaacagccacatttaaattcaaagaaaaatgagtaagattataaggtttgccatgtgaaaacctagagcatattttggaaatgttctaaacctttctaagctcagatgcatttttgcatgactatgtcgaatatttcttactgccatcattatttgttaaagatattttgcacttaattttgtgggaaaaatattgctacaattttttttaatctctgaatgtaatttcgatactgtgtacatagcagggagtgatcggggtgaaataacttgggccagaatattattaaacaatcatcaggcttttagcgacaaggaacacacacatttttcttaaaggcccaatcctaacagactccccgtaccagaggcagatctggaactcgtcaacaacagcccggatcacatgctgttactggactgcccaggtcacctcattgaggtgagcgctgtccctccaggtactcaggcaggtggtgcccaggctccctcccttggcgtccttcttcctgcgccaaacccatctcatccttaagatcagaaaatggaaccccctttgtcgtgaaaccgatcaagcattttgacaggaagcccttcattattcataacattgtatgctgaccaagacgtcagaagaccacctgtgcccttttctctcgtggaagataaaacctggactcagggagcaaccacaggctctccactttgaaactttagtttgaattttaaaagataggaagtaatacagtttaagttcctttctcacactcagtattgcatgcttagtgctggttttcttacaacattttggcaggtgtagctttttctgttaaaaatggtatacatgaagtcacatacttttttaaaggaacactcagaacattctgtcattccagtcagaaactgtcttttgaaatatttctttacaacctaccaaaaaaggaaggttgttttttctacatgtgcttgggtatctaacatctaccattaaaacaacaaatggcttgcagacagggcagtaatggtttatcctaaattactcaaccccttgtagccttgacaaattttaccttaaaaccaaaatgaaacacaaaaattaatccttaataatgatagcaagtgatctttctttttagttttagccttcctttttcaatagtaatatttaaacccacttttgaccaattgtttgcccaaatattcttgtcatttggagtcagtggaaaatccagcacaccaagcaccagtcttcttctgaggcaaaagaaaagtgttgtcattttcactctgttggagctgcacacttttttttctttttttttttctttttttttttgtcgtgtaagaaggatgctggtcagagctgcagaaaatatgaggcaattaaaagtctttagctgttagcaaacctgttagttttacttctgcattgaaccagcctcagaagctacttactgctttatgtactctttgggcattaatgccttctctgtaattatatctcgtttttgcttgacagtgacctacccaataattgcatcgtgcattgccatgaaaggtaaacacattgtgaactgaacttaccaagcagattctgtgagaaagcactggttgaggctgaacactgttgacacatcatttttattggaagagtattaactggtgcctcttctgaaacacaccaacccatattcctctgctcccccaaagctgtttctgatcctgctgggagcaactaactagttattatgcacatctgctccagacccagctctttaacttcatggttttacagcttgttttttctttttcttttctttttttttttttttttttaaaaaagcacctttttttgttgtttccccttaataaaagaggtttctaatttatgtttctctaagatttcctttggttgtatttagaaacacaaatagttttataatcaggattgcatttgtgctgggtaaaagaggagagctgtgctttctaccccaaagttgttggtaatggagccggtctgcccttcctacaaactcaagaggctcattgttcaaggtgtaacaacatttaattgcatgtcctctaacgctttgaaacctttagagggaagatcctcattttttacaattttgttccttttcatcatagaaaacatgtttaagataaaatacaaactttacctaccccaaattcataaagtacatttagtgctgtatagcactaaaacttagagatacagacactgtacttactttttaagaattagagacagtaactccaaaaataattgtccttttttctttctttctttttttacaataaggctcttgaaaattgtcattacttgtgttttcctatacattcatctgtgtgaaagcctttttcttctttgatttaaaaaaattaactatacagttaatggtttagaacttagaactacttagaattaatgctaaagtgtcaggaagaaattaatttagcttcaataattgtgactggcctcaggaattctcccttccacacctgcccacctcacctcactgcaccgcaccgcaccagagccagagcagctgcttgtctgcagcaggacacagttcctacatacgtttcagttctttcatggtaagctcaatggactttgaattgtttacagtgctgtatgtccaattgttaaatgtaccattctgaacgatgttaaagcaagtgtggtttatttatggcatgaaccatgtaacttgaaatatgaacttacaaggaggggcactcattaggtaacaagttcttacaccaaacttccttgatgaaataagccaaaataatcctaaaattcattagaagaacttgataaaagactcaaataaatgttagaaagagcccgtaattttaggactcctataaaattcttccttgtttgttaatgctattaaaactcagattcaagggaaataccagcttccacttgagtcactttgaaatagttaattcaacagcaccatgttagaaatatattggcagccaagactctgaactctgcagaaacatttgtttcacccagacttcaaactctagccctgactatgatgcccctgtgtgcatttacaataaagactccaacggagggagcctgttggtgttaaattgtttacatttctttatacaaataatgtgctttcagtgccttagttacagctccctttctgtttcttgttccaaggattctgtagtatgtagtgtgtttcttaggtaaagtctctttttgctactgaaagggaaatggtctctaaacactggtcactgtagcaggtaaacactactctaacgtggagaaatgagcttcatgctgaggtagtggttgccttagagctgttatttatgctgtagaaaacgaaaatggttttgctacctgataagcttcagattagatatagccctaaagttatcctgtacctgcattaaattttcattttagaagagaatcttggttttggtaattcatttttttttaagatcattatgtgcaaaacaccaagttttaaaaataactcacagaatggccttagttttcaatgtctgatggtatatttgtgagttgtgttatctgtaatatacatcccagaataaaggagtgaattaaatagttta

SEQ ID NO: 16668 - DNA, 2774 bp, Homo sapiens
attactagggcgacggccggacgcctccgcgttacgggatgaattaacggcgggttccgcacggaggttgtgacccctacggagccccagcttgcccacgcaccccactcggcgtcgcgcggcgtgccctgcttgtcacaggctgaaaaacagagtgggtactctcttctgggaagctggcaacaaatggatgatgtgatatatgcattccaggggaagggaaattgtggtgcttctgaacccatggtcaattaacgaggcagtttctagctactgcacgtacttcataaagcaggactctaaaagctttggaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggttgggccatgcaggctgctgcctatatcttcattcataggaaatggaaggatgacaagagccatttcgaagacatgattgattacttttgtgatattcacgaaccacttcaactcctcatattcccagaagggactgatctcacagaaaacagcaagtctcgaagtaatgcatttgctgaaaaaaatggacttcagaaatatgaatatgttttacatccaagaactacaggctttacttttgtggtagaccgtctaagagaaggcaggaggcagagcgagggaagtaaaggaccacttcaaggagaactacaaatcactgctcaaggaaatcagagaggacacaaacaaatggaaaaacactccatgctcatggattggaagaatcaatatcgtgaaattggccatactgcccaaagcaatttacagattcaatgctattcccattaaactgccgttgacattcttcatagaattagaaaaaactcttaaaattcatatggaaccaacaaaaagcccatatagccaagacaatcttaagcaaaaagaacacagctggaggcatcacattacctgacttcaaactatactacagggctacagtaaccaaaatagcatggtactgttacaaaaacagacacatagaccaatggaacagaatagagaactcagaaataagtccgtgcaactacagccatctgatctttgacaaacctgacaaaaacaagcaatggggaaaggattccctatttaataaatggtgctgggagaactggctagccatatgcagaaaactgaaactggaccccttccttacaccttatgcaaaaattaactcaagatggattaaagacttaaatgaaaaacccaaaactataaaaaccctagaaaaaaatctaggcaataccattcaggacataagcatgggcaaagatttcatgatgaagatgacaaaagcaattgcaaccaaagcaaaaattgacaaatgggatctgattaaactaaagggcttctgcacaggaaaagaaactatcatcagagcaaacagacattctacagaaagggagaaaatttttgcaatctatccatctgacaaaggtctaatattcagagtcaacaagaaactaaaacaaatttacaagaaaaaacaaccccattaaaaaagtgggcaagggacatgaacagacacttctcaaaagaagacatttatatggctaataaacttatgaaaaaaagctcaacatcactgatcatcagagaaatgcaaatcaaaaccacaatgagataccatctcacaccagtccaaatggcaattatttaaaagtcatgaaacaacagatgctggcaaggctgtggagcgagaggaatgcttttacattgttggtgggaatgtatattagttcaaccattgtgtagctgggactacaggcgtccactaccacgcccggctaatttttttgtatttttagtagagacagggtttcaccatgttagccaggatggtctcgatctcctgacctcatgatccacccgcctcagcttcccaaagtgctgggattacaggcatgagccaccgcgcccagccaaggaaatatctttatagatgtcttcttgtgtacctgtgtaagaattcctttgggatatacagtcatgcaacacataatgacgttctagttagtggcaaaccacatatatgatggcagtctcataagatcataatggagctagaaaattcctatcacctggtgacatcatcacatgtttgtgatgatgctgatgtaaaccactatgctaccagttgtgtaaaacagtagcacataaaattatataccgtaatgataatgactatgttactgatttacatagttactgtactatactttttattgttacttgagtgtattccttctgcttatagtaaaagcagtaaaacagccccaggcaggtccttcaggaggtattccagaagaaggcattgctgtcataggacatgacagctccatgcttgttattacctctgaagaccttgcagtgagacaagatgtggaggtgaagacagtgatattgatgatcctgaccctgtgtaggcctaggc

SEQ ID NO: 16669 - DNA, 1136 bp, Homo sapiens
ggccggacgcctccgcgttacgggatgaattaacggcgggttccgcacggaggttgtgacccctacggagccccagcttgcccacgcaccccactcggcgtcgcgcggcgtgccctgcttgtcacaggtgggaggctggaactatcaggctgaaaaacagagtgggtactctcttctgggaagctggcaacaaatggatgatgtgatatatgcattccaggggaagggaaattgtggtgcttctgaacccatggtcaattaacgaggcagtttctagctactgcacgtacttcataaagcaggactctaaaagctttggaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggttgggccatgcaggctgctgcctatatcttcattcataggaaatggaaggatgacaagagccatttcgaagacatgattgattacttttgtgatattcacgaaccacttcaactcctcatattcccagaagggactgatctcacagaaaacagcaagtctcgaagtaatgcatttgctgaaaaaaatggacttcagaaatatgaatatgttttacatccaagaactacaggctttacttttgtggtagaccgtctaagagaaggcaggaggcagagcgagggaagtaaaggaccacttcaaggagaactacaaatcactgctcaaggaaatcagagaggacacaaacaaatggaaaaacactccatgctcatggattggaagaatcaatatcgtgaaattggccatactgcccaaagcaatttacagattcaatgctattcccattaa

SEQ ID NO: 16670 - DNA, 4888 bp, Homo sapiens
gggacgcattactagggcgacggccggacgcctccgcgttacgggatgaattaacggcgggttccgcacggaggttgtgacccctacggagccccagcttgcccacgcaccccactcggcgtcgcgcggcgtgccctgcttgtcacagaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggttgggccatgcaggctgctgcctatatcttcattcataggaaatggaaggatgacaagagccatttcgaagacatgattgattacttttgtgatattcacgaaccacttcaactcctcatattcccagaagggactgatctcacagaaaacagcaagtctcgaagtaatgcatttgctgaaaaaaatggacttcagaaatatgaatatgttttacatccaagaactacaggctttacttttgtggtagaccgtctaagagaaggtaagaaccttgatgctgtccatgatatcactgtggcgtatcctcacaacattcctcaatcagagaagcacctcctccaaggagactttcccagggaaatccactttcacgtccaccggtatccaatagacaccctccccacatccaaggaggaccttcaactctggtgccacaaacggtgggaagagaaagaagagaggctgcgttccttctatcaaggggagaagaatttttattttaccggacagagtgtcattccaccttgcaagtctgaactcagggtccttgtggtcaaattgctctctatactgtattggaccctgttcagccctgcaatgtgcctactcatatatttgtacagtcttgttaagtggtattttataatcaccattgtaatctttgtgctgcaagagagaatatttggtggactggagatcatagaacttgcatgttaccgacttttacacaaacagccacatttaaattcaaagaaaaatgagtaagattataaggtttgccatgtgaaaacctagagcatattttggaaatgttctaaacctttctaagctcagatgcatttttgcatgactatgtcgaatatttcttactgccatcattatttgttaaagatattttgcacttaattttgtgggaaaaatattgctacaattttttttaatctctgaatgtaatttcgatactgtgtacatagcagggagtgatcggggtgaaataacttgggccagaatattattaaacaatcatcaggcttttagcgacaaggaacacacacatttttcttaaaggcccaatcctaacagactccccgtaccagaggcagatctggaactcgtcaacaacagcccggatcacatgctgttactggactgcccaggtcacctcattgaggtgagcgctgtccctccaggtactcaggcaggtggtgcccaggctccctcccttggcgtccttcttcctgcgccaaacccatctcatccttaagatcagaaaatggaaccccctttgtcgtgaaaccgatcaagcattttgacaggaagcccttcattattcataacattgtatgctgaccaagacgtcagaagaccacctgtgcccttttctctcgtggaagataaaacctggactcagggagcaaccacaggctctccactttgaaactttagtttgaattttaaaagataggaagtaatacagtttaagttcctttctcacactcagtattgcatgcttagtgctggttttcttacaacattttggcaggtgtagctttttctgttaaaaatggtatacatgaagtcacatacttttttaaaggaacactcagaacattctgtcattccagtcagaaactgtcttttgaaatatttctttacaacctaccaaaaaaggaaggttgttttttctacatgtgcttgggtatctaacatctaccattaaaacaacaaatggcttgcagacagggcagtaatggtttatcctaaattactcaaccccttgtagccttgacaaattttaccttaaaaccaaaatgaaacacaaaaattaatccttaataatgatagcaagtgatctttctttttagttttagccttcctttttcaatagtaatatttaaacccacttttgaccaattgtttgcccaaatattcttgtcatttggagtcagtggaaaatccagcacaccaagcaccagtcttcttctgaggcaaaagaaaagtgttgtcattttcactctgttggagctgcacacttttttttctttttttttttctttttttttttgtcgtgtaagaaggatgctggtcagagctgcagaaaatatgaggcaattaaaagtctttagctgttagcaaacctgttagttttacttctgcattgaaccagcctcagaagctacttactgctttatgtactctttgggcattaatgccttctctgtaattatatctcgtttttgcttgacagtgacctacccaataattgcatcgtgcattgccatgaaaggtaaacacattgtgaactgaacttaccaagcagattctgtgagaaagcactggttgaggctgaacactgttgacacatcatttttattggaagagtattaactggtgcctcttctgaaacacaccaacccatattcctctgctcccccaaagctgtttctgatcctgctgggagcaactaactagttattatgcacatctgctccagacccagctctttaacttcatggttttacagcttgttttttctttttcttttctttttttttttttttttttaaaaaagcacctttttttgttgtttccccttaataaaagaggtttctaatttatgtttctctaagatttcctttggttgtatttagaaacacaaatagttttataatcaggattgcatttgtgctgggtaaaagaggagagctgtgctttctaccccaaagttgttggtaatggagccggtctgcccttcctacaaactcaagaggctcattgttcaaggtgtaacaacatttaattgcatgtcctctaacgctttgaaacctttagagggaagatcctcattttttacaattttgttccttttcatcatagaaaacatgtttaagataaaatacaaactttacctaccccaaattcataaagtacatttagtgctgtatagcactaaaacttagagatacagacactgtacttactttttaagaattagagacagtaactccaaaaataattgtccttttttctttctttctttttttacaataaggctcttgaaaattgtcattacttgtgttttcctatacattcatctgtgtgaaagcctttttcttctttgatttaaaaaaattaactatacagttaatggtttagaacttagaactacttagaattaatgctaaagtgtcaggaagaaattaatttagcttcaataattgtgactggcctcaggaattctcccttccacacctgcccacctcacctcactgcaccgcaccgcaccagagccagagcagctgcttgtctgcagcaggacacagttcctacatacgtttcagttctttcatggtaagctcaatggactttgaattgtttacagtgctgtatgtccaattgttaaatgtaccattctgaacgatgttaaagcaagtgtggtttatttatggcatgaaccatgtaacttgaaatatgaacttacaaggaggggcactcattaggtaacaagttcttacaccaaacttccttgatgaaataagccaaaataatcctaaaattcattagaagaacttgataaaagactcaaataaatgttagaaagagcccgtaattttaggactcctataaaattcttccttgtttgttaatgctattaaaactcagattcaagggaaataccagcttccacttgagtcactttgaaatagttaattcaacagcaccatgttagaaatatattggcagccaagactctgaactctgcagaaacatttgtttcacccagacttcaaactctagccctgactatgatgcccctgtgtgcatttacaataaagactccaacggagggagcctgttggtgttaaattgtttacatttctttatacaaataatgtgctttcagtgccttagttacagctccctttctgtttcttgttccaaggattctgtagtatgtagtgtgtttcttaggtaaagtctctttttgctactgaaagggaaatggtctctaaacactggtcactgtagcaggtaaacactactctaacgtggagaaatgagcttcatgctgaggtagtggttgccttagagctgttatttatgctgtagaaaacgaaaatggttttgctacctgataagcttcagattagatatagccctaaagttatcctgtacctgcattaaattttcattttagaagagaatcttggttttggtaattcatttttttttaagatcattatgtgcaaaacaccaagttttaaaaataactcacagaatggccttagttttcaatgtctgatggtatatttgtgagttgtgttatctgtaatatacatcccagaataaaggagtgaattaaatagttt

SEQ ID NO: 16671 - DNA, 4883 bp, Homo sapiens
gggacgcattactagggcgacggccggacgcctccgcgttacgggatgaattaacggcgggttccgcacggaggttgtgacccctacggagccccagcttgcccacgcaccccactcggcgtcgcgcggcgtgccctgcttgtcacagaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggttgggccatgcaggctgctgcctatatcttcattcataggaaatggaaggatgacaagagccatttcgaagacatgattgattacttttgtgatattcacgaaccacttcaactcctcatattcccagaagggactgatctcacagaaaacagcaagtctcgaagtaatgcatttgctgaaaaaaatggacttcagaaatatgaatatgttttacatccaagaactacaggctttacttttgtggtagaccgtctaagagaaggtaagaaccttgatgctgtccatgatatcactgtggcgtatcctcacaacattcctcaatcagagaagcacctcctccaaggagactttcccagggaaatccactttcacgtccaccggtatccaatagacaccctccccacatccaaggaggaccttcaactctggtgccacaaacggtgggaagagaaagaagagaggctgcgttccttctatcaaggggagaagaatttttattttaccggacagagtgtcattccaccttgcaagtctgaactcagggtccttgtggtcaaactctatactgtattggaccctgttcagccctgcaatgtgcctactcatatatttgtacagtcttgttaagtggtattttataatcaccattgtaatctttgtgctgcaagagagaatatttggtggactggagatcatagaacttgcatgttaccgacttttacacaaacagccacatttaaattcaaagaaaaatgagtaagattataaggtttgccatgtgaaaacctagagcatattttggaaatgttctaaacctttctaagctcagatgcatttttgcatgactatgtcgaatatttcttactgccatcattatttgttaaagatattttgcacttaattttgtgggaaaaatattgctacaattttttttaatctctgaatgtaatttcgatactgtgtacatagcagggagtgatcggggtgaaataacttgggccagaatattattaaacaatcatcaggcttttagcgacaaggaacacacacatttttcttaaaggcccaatcctaacagactccccgtaccagaggcagatctggaactcgtcaacaacagcccggatcacatgctgttactggactgcccaggtcacctcattgaggtgagcgctgtccctccaggtactcaggcaggtggtgcccaggctccctcccttggcgtccttcttcctgcgccaaacccatctcatccttaagatcagaaaatggaaccccctttgtcgtgaaaccgatcaagcattttgacaggaagcccttcattattcataacattgtatgctgaccaagacgtcagaagaccacctgtgcccttttctctcgtggaagataaaacctggactcagggagcaaccacaggctctccactttgaaactttagtttgaattttaaaagataggaagtaatacagtttaagttcctttctcacactcagtattgcatgcttagtgctggttttcttacaacattttggcaggtgtagctttttctgttaaaaatggtatacatgaagtcacatacttttttaaaggaacactcagaacattctgtcattccagtcagaaactgtcttttgaaatatttctttacaacctaccaaaaaaggaaggttgttttttctacatgtgcttgggtatctaacatctaccattaaaacaacaaatggcttgcagacagggcagtaatggtttatcctaaattactcaaccccttgtagccttgacaaattttaccttaaaaccaaaatgaaacacaaaaattaatccttaataatgatagcaagtgatctttctttttagttttagccttcctttttcaatagtaatatttaaacccacttttgaccaattgtttgcccaaatattcttgtcatttggagtcagtggaaaatccagcacaccaagcaccagtcttcttctgaggcaaaagaaaagtgttgtcattttcactctgttggagctgcacacttttttttctttttttttttctttttttttttgtcgtgtaagaaggatgctggtcagagctgcagaaaatatgaggcaattaaaagtctttagctgttagcaaacctgttagttttacttctgcattgaaccagcctcagaagctacttactgctttatgtactctttgggcattaatgccttctctgtaattatatctcgtttttgcttgacagtgacctacccaataattgcatcgtgcattgccatgaaaggtaaacacattgtgaactgaacttaccaagcagattctgtgagaaagcactggttgaggctgaacactgttgacacatcatttttattggaagagtattaactggtgcctcttctgaaacacaccaacccatattcctctgctcccccaaagctgtttctgatcctgctgggagcaactaactagttattatgcacatctgctccagacccagctctttaacttcatggttttacagcttgttttttctttttcttttctttttttttttttttttttaaaaaagcacctttttttgttgtttccccttaataaaagaggtttctaatttatgtttctctaagatttcctttggttgtatttagaaacacaaatagttttataatcaggattgcatttgtgctgggtaaaagaggagagctgtgctttctaccccaaagttgttggtaatggagccggtctgcccttcctacaaactcaagaggctcattgttcaaggtgtaacaacatttaattgcatgtcctctaacgctttgaaacctttagagggaagatcctcattttttacaattttgttccttttcatcatagaaaacatgtttaagataaaatacaaactttacctaccccaaattcataaagtacatttagtgctgtatagcactaaaacttagagatacagacactgtacttactttttaagaattagagacagtaactccaaaaataattgtccttttttctttctttctttttttacaataaggctcttgaaaattgtcattacttgtgttttcctatacattcatctgtgtgaaagcctttttcttctttgatttaaaaaaattaactatacagttaatggtttagaacttagaactacttagaattaatgctaaagtgtcaggaagaaattaatttagcttcaataattgtgactggcctcaggaattctcccttccacacctgcccacctcacctcactgcaccgcaccgcaccagagccagagcagctgcttgtctgcagcaggacacagttcctacatacgtttcagttctttcatggtaagctcaatggactttgaattgtttacagtgctgtatgtccaattgttaaatgtaccattctgaacgatgttaaagcaagtgtggtttatttatggcatgaaccatgtaacttgaaatatgaacttacaaggaggggcactcattaggtaacaagttcttacaccaaacttccttgatgaaataagccaaaataatcctaaaattcattagaagaacttgataaaagactcaaataaatgttagaaagagcccgtaattttaggactcctataaaattcttccttgtttgttaatgctattaaaactcagattcaagggaaataccagcttccacttgagtcactttgaaatagttaattcaacagcaccatgttagaaatatattggcagccaagactctgaactctgcagaaacatttgtttcacccagacttcaaactctagccctgactatgatgcccctgtgtgcatttacaataaagactccaacggagggagcctgttggtgttaaattgtttacatttctttatacaaataatgtgctttcagtgccttagttacagctccctttctgtttcttgttccaaggattctgtagtatgtagtgtgtttcttaggtaaagtctctttttgctactgaaagggaaatggtctctaaacactggtcactgtagcaggtaaacactactctaacgtggagaaatgagcttcatgctgaggtagtggttgccttagagctgttatttatgctgtagaaaacgaaaatggttttgctacctgataagcttcagattagatatagccctaaagttatcctgtacctgcattaaattttcattttagaagagaatcttggttttggtaattcatttttttttaagatcattatgtgcaaaacaccaagttttaaaaataactcacagaatggccttagttttcaatgtctgatggtatatttgtgagttgtgttatctgtaatatacatcccagaataaaggagtgaattaaatagttt

SEQ ID NO: 16672 - DNA, 658 bp, Homo sapiens
gaggctggaactatcaggtggggttacggcgcgaggaaaatggcggcggccgggggatctcagaggtgcaggaaggggagctgcagcccgggcttttcctcctgagccatggaccttccccgggccgcgacctcgggctgaaaaacagagtgggtactctcttctgggaagctggcaacaaatggatgatgtgatatatgcattccaggggaagggaaattgtggtgcttctgaacccatggtcaattaacgaggcagtttctagctactgcacgtacttcataaagcaggactctaaaagctttggaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaa

SEQ ID NO: 16673 - DNA, 1862 bp, Homo sapiens
gttacgggatgaattaacggcgggttccgcacggaggttgtgacccctacggagccccagcttgcccacgcaccccactcggcgtcgcgcggcgtgccctgcttgtcacaggctgaaaaacagagtgggtactctcttctgggaagctggcaacaaatggatgatgtgatatatgcattccaggggaagggaaattgtggtgcttctgaacccatggtcaattaacgaggcagtttctagctactgcacgtacttcataaagcaggactctaaaagctttggccactccacatcacttgaattatctcctgatttccacctctgctcagatccgccactgcattcgattcttacaggaacgcaggccctataactgtgcttgcaggggatctaggttgcatgttccttaggagaatctaatgcctgatgatctgtcactgtctcctatcatccccagataggaccatctagtctcaggaaaacaagctcagaacgctcgccgattctaccattatgaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggttgggccatgcaggctgctgcctatatcttcattcataggaaatggaaggatgacaagagccatttcgaagacatgattgattacttttgtgatattcacgaaccacttcaactcctcatattcccagaagggactgatctcacagaaaacagcaagtctcgaagtaatgcatttgctgaaaaaaatggacttcagaaatatgaatatgttttacatccaagaactacaggctttacttttgtggtagaccgtctaagagaaggtaagaaccttgatgctgtccatgatatcactgtggcgtatcctcacaacattcctcaatcagagaagcacctcctccaaggagactttcccagggaaatccactttcacgtccaccggtatccaatagacaccctccccacatccaaggaggaccttcaactctggtgccacaaacggtgggaagagaaagaagagaggctgcgttccttctatcaaggggagaagaatttttattttaccggacagagtgtcattccaccttgcaagtctgaactcagggtccttgtggtcaaattgctctctatactgtattggaccctgttcagccctgcaatgtgcctactcatatatttgtacagtcttgttaagtggtattttataatcaccattgtaatctttgtgctgcaagagagaatatttggtggactggagatcatagaacttgcatgttaccgacttttacacaaacagccacatttaaattcaaagaaaaatgagtaagattataaggtttgccatgtgaaaacctagagcatattttggaaatgttctaaacctttctaagctcagatgcatttttgcatgactatgtcgaatatttcttactgccatcattatttgttaaagatattttgcacttaattttgtgggaaaaatattgctacaattttttttaatctctgaatgtaatttcgatactgtgtacatagca

SEQ ID NO: 16674 - DNA, 2687 bp, Homo sapiens
acggcgcgctgggctcacactgtcccgccgcggacgggctttgtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgt

SEQ ID NO: 16675 - DNA, 2995 bp, Homo sapiens
agaaagcagggctgcatggtgtggggatgctgctgctactcattcctgctcattccagtgttctggaaaatgaggtgtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgaaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcata

SEQ ID NO: 16676 - DNA, 3637 bp, Homo sapiens
gtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgaaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacgtactttatacaaaatacagaatactttatattggaagtgaaagaaatgaacgtggacttttacacatgtgcatatttttctggaggctatatggattatttgaaatgaaaagcatactaattggactttaataaatcattttcaatca

SEQ ID NO: 16677 - DNA, 1019 bp, Homo sapiens
ctggcggctgacgctccctgagtggcgactccgtctccagccccgctgcggagcgcgggccggatctggggcggccagggcccggagccgcggagccctccccgccgcccggccgagcacgggaccccggcggggtgggcgcagggggcggccccgctctgggcgactgccgaggggcgggcggagggccgggctcggctggcggtggggcgggggccgccgggactgggcgcgcggcctgaagccagcccgggggcggcaggagagggacgcgcggcggcagcgagcgcaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctataccc

SEQ ID NO: 16678 - DNA, 2490 bp, Homo sapiens
ctcaagggaacagctcctgcccaggtctgtgggcactcagcatggatttcagtctccctgtgagtgatgggaaagaactaacagaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagtgggaggtgatttcttctttggcgagagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcatt

SEQ ID NO: 16679 - DNA, 1345 bp, Homo sapiens
gaatggaggagggggcgcagaggtcaggggcgctgggggcgccacaccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgc

SEQ ID NO: 16680 - DNA, 3255 bp, Homo sapiens
atgctgctgctactcattcctgctcattccagtgttctggaaaatgagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgaaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacgtactttatacaaaatacagaatactttatattggaagtgaaagaaatgaacgtggacttttacacatgtgcatatttttctggaggctatatggattatttgaaatgaaaagcatactaattggactttaataaatcattttcaatc

SEQ ID NO: 16681 - DNA, 1792 bp, Homo sapiens
ctcccgcgccctctcagcaacccgcacagggcgcacccggacgctctaccgctcccgccgcagtcgccgggccatgggcctcgagcccgccccgaacccccgcgagcccgccttgtctgcggcgtgactggaggcccagatggtcatcatgggccagtgctactacaacgagaccatcggcttcttctataacaacagtggcaaagagctcagctcccactggcggcccaaggatgtggtcgtggtggcactggggctgaccgtcagcgtgctggtgctgctgaccaatctgctggtcatagcagccatcgcctccaaccgccgcttccaccagcccatctactacctgctcggcaatctggccgcggctgacctcttcgcgggcgtggcctacctcttcctcatgttccacactggtccccgcacagcccgactttcacttgagggctggttcctgcggcagggcttgctggacacaagcctcactgcgtcggtggccacactgctggccatcgccgtggagcggcaccgcagtgtgatggccgtgcagctgcacagccgcctgccccgtggccgcgtggtcatgctcattgtgggcgtgtgggtggctgccctgggcctggggctgctgcctgcccactcctggcactgcctctgtgccctggaccgctgctcacgcatggcacccctgctcagccgctcctatttggccgtctgggctctgtcgagcctgcttgtcttcctgctcatggtggctgtgtacacccgcattttcttctacgtgcggcggcgagtgcagcgcatggcagagcatgtcagctgccacccccgctaccgagagaccacgctcagcctggtcaagactgttgtcatcatcctgggggcgttcgtggtctgctggacaccaggccaggtggtactgctcctggatggtttaggctgtgagtcctgcaatgtcctggctgtagaaaagtacttcctactgttggccgaggccaactccctggtcaatgctgctgtgtactcttgccgagatgctgagatgcgccgcaccttccgccgccttctctgctgcgcgtgcctccgccagtccacccgcgagtctgtccactatacatcctctgcccagggaggtgccagcactcgcatcatgcttcccgagaacggccacccactgatggactccaccctttagctaccttgaacttcagcggtacgcggcaagcaacaaatccacagcccctgatgacttgtgggtgctcctggctcaacccaaccaacaggactgactgactggcaggacaaggtctggcatggcacagcaccactgccaggcctccccaggcacaccactctgcccagggaatgggggctttgggtcatctcccactgcctgggggagtcagatggggtgcaggaatctggctcttcagccatctcaggtttagggggtttgtaacagacattattctgttttcactgcgtatccttggtaagccctgtggactggttcctgctgtgtgatgctgagggttttaaggtggggagagataagggctctctcgggccatgctacccggtatgactgggtaatgaggacagactgtggacaccccatctacctgagtctgattctttagcagcagagactgaggggtgcagagtgtgagctgggaaaggtttgtggctccttgcagcctccagggactggcctgtccccgatagaattgaagcagtccacggggaggggatgatacaaggagtaaacctttctttacactctgaggtctcc

SEQ ID NO: 16682 - DNA, 2546 bp, Homo sapiens
ataacaaagtaccgataaccgggacaatggggctgtgtgctccggaccgtgggagcccggggccgccgcagggaggccgagggaggaagccacagggcagggcagggcagggccgggctttgcagggggcagcgctgtcccagggtgaggggtacgggggcgggattgcaaaaccctagcgtgcgcccgatgatcagctggggccgcagaggtgggcctcgcacaggaggccgcggctcgctgatactgcgagctggcaaagccgaagctgggcgggggtccgggcggtgggagccaagtcggatcagggagtggcttgtaactcggcggccgattggacacgaagaagagagcggggtggggctgggagggttgggggtccggagcgggggcgcggacccaagaccacctggagctccgcccgggcagcgcggggtcacggcgggaattttcgggtcgccgagtgactcagccccgcaggctcgaaactgcgggcgcatgagtcgccgggccatgggcctcgagcccgccccgaacccccgcgagcccgccttgtctgcggcgtgactggaggcccagtctggagacgcctggaggcccggccatccatcccttccccaaccgctgtctttgtcccggagaccgccagtgtcctccgtcccacccggaacagcctattgccccgcccgcttgggaagcactcgcgcccaaatcccgccgactaacttctggggccgcctctctgtccactccgatcacctccacgcctcggcaccgccccctcgcagggttctagtcttattagtaggtaagaaacagctgctcctccacctccaccccagccccatggagcttgctttttccaggccaccgtagtcctcaccactgccactttgcttcgagatggtcatcatgggccagtgctactacaacgagaccatcggcttcttctataacaacagtggcaaagagctcagctcccactggcggcccaaggatgtggtcgtggtggcactggggctgaccgtcagcgtgctggtgctgctgaccaatctgctggtcatagcagccatcgcctccaaccgccgcttccaccagcccatctactacctgctcggcaatctggccgcggctgacctcttcgcgggcgtggcctacctcttcctcatgttccacactggtccccgcacagcccgactttcacttgagggctggttcctgcggcagggcttgctggacacaagcctcactgcgtcggtggccacactgctggccatcgccgtggagcggcaccgcagtgtgatggccgtgcagctgcacagccgcctgccccgtggccgcgtggtcatgctcattgtgggcgtgtgggtggctgccctgggcctggggctgctgcctgcccactcctggcactgcctctgtgccctggaccgctgctcacgcatggcacccctgctcagccgctcctatttggccgtctgggctctgtcgagcctgcttgtcttcctgctcatggtggctgtgtacacccgcattttcttctacgtgcggcggcgagtgcagcgcatggcagagcatgtcagctgccacccccgctaccgagagaccacgctcagcctggtcaagactgttgtcatcatcctgggggcgttcgtggtctgctggacaccaggccaggtggtactgctcctggatggtttaggctgtgagtcctgcaatgtcctggctgtagaaaagtacttcctactgttggccgaggccaactccctggtcaatgctgctgtgtactcttgccgagatgctgagatgcgccgcaccttccgccgccttctctgctgcgcgtgcctccgccagtccacccgcgagtctgtccactatacatcctctgcccagggaggtgccagcactcgcatcatgcttcccgagaacggccacccactgatggactccaccctttagctaccttgaacttcagcggtacgcggcaagcaacaaatccacagcccctgatgacttgtgggtgctcctggctcaacccaaccaacaggactgactgactggcaggacaaggtctggcatggcacagcaccactgccaggcctccccaggcacaccactctgcccagggaatgggggctttgggtcatctcccactgcctgggggagtcagatggggtgcaggaatctggctcttcagccatctcaggtttagggggtttgtaacagacattattctgttttcactgcgtatccttggtaagccctgtggactggttcctgctgtgtgatgctgagggttttaaggtggggagagataagggctctctcgggccatgctacccggtatgactgggtaatgaggacagactgtggacaccccatctacctgagtctgattctttagcagcagagactgaggggtgcagagtgtgagctgggaaaggtttgtggctccttgcagcctccagggactggcctgtccccgatagaattgaagcagtccacggggaggggatgatacaaggagtaaacctttctttacactc

SEQ ID NO: 16683 - DNA, 1720 bp, Homo sapiens
aaactttcctttggctctggacgcgtcgcaggggtcgctggagaggaggcgctccgcccgcccgccgcgtcctccgctgcttctccgcgcccggctggagcccggcgcccggtcgccccgtcgcgctcgaccccgagggcatgcggcagccgcaggggcccccgctcccgggctcggcggcgcgggtgaacgtgagcggatgttcacttctccacaatgaatgagtgtcactatgacaagcacatggactttttttataataggagcaacactgatactgtcgatgactggacaggaacaaagcttgtgattgttttgtgtgttgggacgtttttctgcctgtttatttttttttctaattctctggtcatcgcggcagtgatcaaaaacagaaaatttcatttccccttctactacctgttggctaatttagctgctgccgatttcttcgctggaattgcctatgtattcctgatgtttaacacaggcccagtttcaaaaactttgactgtcaaccgctggtttctccgtcaggggcttctggacagtagcttgactgcttccctcaccaacttgctggttatcgccgtggagaggcacatgtcaatcatgaggatgcgggtccatagcaacctgaccaaaaagagggtgacactgctcattttgcttgtctgggccatcgccatttttatgggggcggtccccacactgggctggaattgcctctgcaacatctctgcctgctcttccctggcccccatttacagcaggagttaccttgttttctggacagtgtccaacctcatggccttcctcatcatggttgtggtgtacctgcggatctacgtgtacgtcaagaggaaaaccaacgtcttgtctccgcatacaagtgggtccatcagccgccggaggacacccatgaagctaatgaagacggtgatgactgtcttaggggcgtttgtggtatgctggaccccgggcctggtggttctgctcctcgacggcctgaactgcaggcagtgtggcgtgcagcatgtgaaaaggtggttcctgctgctggcgctgctcaactccgtcgtgaaccccatcatctactcctacaaggacgaggacatgtatggcaccatgaagaagatgatctgctgcttctctcaggagaacccagagaggcgtccctctcgcatcccctccacagtcctcagcaggagtgacacaggcagccagtacatagaggatagtattagccaaggtgcagtctgcaataaaagcacttcctaaactctggatgcctctcggcccacccaggcctcctctgggaaaagagctgttaagaatgattacctgtctctaacaaagcccatgtacagtgttatttgaggtctccattaatcactgctagatttctttaaaaaattttttttcatagtttaaaagcatgggcagtaaagagaggacctgctgcatttagagaaagcacagaaacgggagaggttcggcgggtccctgcttgtcctatgaactgctcagagctcctgtcagtccagctgggccttctgggttctggcaccatttcgtagccattctctttgtattttaaaaggacgttatgaaagggcttagaccaaaataaatcataatgttacttgagccaccttatatagctgcttggagagtctatgtagttctttctgcatgcattaaaaatgtttagaaatgcttc

SEQ ID NO: 16684 - DNA, 3345 bp, Homo sapiens
cttctttaaatttctttctaggatgttcacttctccacaatgaatgagtgtcactatgacaagcacatggactttttttataataggagcaacactgatactgtcgatgactggacaggaacaaagcttgtgattgttttgtgtgttgggacgtttttctgcctgtttatttttttttctaattctctggtcatcgcggcagtgatcaaaaacagaaaatttcatttccccttctactacctgttggctaatttagctgctgccgatttcttcgctggaattgcctatgtattcctgatgtttaacacaggcccagtttcaaaaactttgactgtcaaccgctggtttctccgtcaggggcttctggacagtagcttgactgcttccctcaccaacttgctggttatcgccgtggagaggcacatgtcaatcatgaggatgcgggtccatagcaacctgaccaaaaagagggtgacactgctcattttgcttgtctgggccatcgccatttttatgggggcggtccccacactgggctggaattgcctctgcaacatctctgcctgctcttccctggcccccatttacagcaggagttaccttgttttctggacagtgtccaacctcatggccttcctcatcatggttgtggtgtacctgcggatctacgtgtacgtcaagaggaaaaccaacgtcttgtctccgcatacaagtgggtccatcagccgccggaggacacccatgaagctaatgaagacggtgatgactgtcttaggggcgtttgtggtatgctggaccccgggcctggtggttctgctcctcgacggcctgaactgcaggcagtgtggcgtgcagcatgtgaaaaggtggttcctgctgctggcgctgctcaactccgtcgtgaaccccatcatctactcctacaaggacgaggacatgtatggcaccatgaagaagatgatctgctgcttctctcaggagaacccagagaggcgtccctctcgcatcccctccacagtcctcagcaggagtgacacaggcagccagtacatagaggatagtattagccaaggtgcagtctgcaataaaagcacttcctaaactctggatgcctctcggcccacccaggcctcctctgggaaaagagctgttaagaatgattacctgtctctaacaaagcccatgtacagtgttatttgaggtctccattaatcactgctagatttctttaaaaaattttttttcatagtttaaaagcatgggcagtaaagagaggacctgctgcatttagagaaagcacagaaacgggagaggttcggcgggtccctgcttgtcctatgaactgctcagagctcctgtcagtccagctgggccttctgggttctggcaccatttcgtagccattctctttgtattttaaaaggacgttatgaaagggcttagaccaaaataaatcataatgttacttgagccaccttatatagctgcttggagagtctatgtagttctttctgcatgcattaaaaatgtttagaaatgcttcagcaatggtgtttttttcctcaaagaaaccatggccagtagctaggtgttcagtaggaatcaaagaaaaatcagtaagagctccagattaaacctgatttttaactgaaggaacattctgaggaaaaatacttaaaagtaaaaaaggtcaatgtgaaaaccctttttgacctgaaaaaggccttagtatggtcctccatgcatgtgtgtgtatatgcatgtgtgtgtgtgtgtgtgtgtgtgtctatatatatatatatatatatatatatatatattcctgtttttactgatttttattgattttgttcaaagatatctggggattggattggggaatgcttaatctgactattgaaagaaacatggatccctggagtatttcagatacggggttaccgccccagactgcctcccgccagtccacattagttctcattttccctcatgatggtgaaaaacagtggagagctagtaaagggtttatgcagaaaacaaggagaagagaatgtgaagtttgaagtgcctatggaacatccagctgataatcttgcctagtaagagcaaaagaagccaagagaacaccaacgtttaaggagcaggtagagaaaacccagcaaaaggacagaggaataagaggaccaaagaacaatgttaagaatcaaggagagaggtcaggcacgctggctcatgcctgtaatcccagcactttgggaggctgaggcaggtggatcacttgaggccaggagtatgagaccagcctgggcaatgtggtgaaattgcatctttactaaaaatacaaaaactagccaggcatggtggcacatgcctgtaataccaggtacttgggaagctgaggcataagaatcacttgaacccgggaggtggaggttgcagagtgagccaagatcgcagcactgcactctagtctgggtgacagagcaagactctgtctcaaaaaaaaaaaaaaaaaaaaaaaaagactagagaatgtcagggaacacatgtgtatatttaaacaacttcactttgcatttaaaaactcgaaggacagcgaaggtgaaatcaattcacgggccacctagactttccagtctaggactagagctgtagcaatgatctgttgtgctgtacaagaaaagagaaagaggtgttcatttgagaacagatgtttttatacatcagagtaaaagctgtattgaagagcaggctgaatcccttccatatagaatgaaatatgagcttgaccccagtccttatcttcagttacctccataccaactggtggcatgttggatttagcatgtagaataatttcccatctcttatttttcccaaggttaatggcatccttctggtacctggcttacatgtgaactgaattttgatctgggttctattttgaatttttctccttcagagacctaagtaggcaacatgaaagacaagtagttaagaaagaaaaaatgatgtttcatacacacaggctaccaacgagagttttctatgtaaaacatttagagtgtattctgatttaaaatgagaataacttcaaggtagatattatagtatttatgtagtttgcaaaagaagtttacatttttttgctattgtgatataacatttatgtgcaagaactacttgtaataaaaggatttgagatgtcatgcttctaaatataatagcctaaaatagagaatattatgatttgaaagtgtagatttcacaaactctgtatagtatgtgggtctatctgaagcttttatcgaagctacctataaaataaaattttaaaagatctgt

SEQ ID NO: 16685 - DNA, 2291 bp, Homo sapiens
cctaccggtccatagtgtcagagtggtgaacccctgcagccagcaggcctcctgaaaaaaaagtccatgggtgacagaagattcattgacttccaattccaagattcaaattcaagcctcagacccaggttgggcaatgctactgccaataatacttgcattgttgatgattccttcaagtataatctcaatggtgctgtctacagtgttgtattcatcttgggtctgataaccaacagtgtctctctgtttgtcttctgtttccgcatgaaaatgagaagtgagactgctatttttatcaccaatctagctgtctctgatttgctttttgtctgtacactaccttttaaaatattttacaacttcaaccgccactggccttttggtgacaccctctgcaagatctctggaactgcattccttaccaacatctatgggagcatgctctttctcacctgtattagtgtggatcgtttcctggccattgtctatccttttcgatctcgtactattaggactaggaggaattctgccattgtgtgtgctggtgtctggatcctagtcctcagtggcggtatttcagcctctttgttttccaccactaatgtcaacaatgcaaccaccacctgctttgaaggcttctccaaacgtgtctggaagacttatttatccaagatcacaatatttattgaagttgttgggtttatcattcctctaatattgaatgtctcttgctcttctgtggtgctgagaactcttcgcaagcctgctactctgtctcaaattgggaccaataagaaaaaagtactgaaaatgatcacagtacatatggcagtctttgtggtatgctttgtaccctacaactctgtcctcttcttgtatgccctggtgcgctcccaagctattactaattgctttttggaaagatttgcaaagatcatgtacccaatcaccttgtgccttgcaactctgaactgttgttttgaccctttcatctattacttcacccttgaatcctttcagaagtccttctacatcaatgcccacatcagaatggagtccctgtttaagactgaaacacctttgaccacaaagccttcccttccagctattcaagaggaagtgagtgatcaaacaacaaataatggtggtgaattaatgctagaatccaccttttaggtatgagaaatgtgttcaggtccagatatggtttctcctataatttttcctatgctataaactaaagatttgaagctaatgatactgagaataatgcaccaaatccagtcagatacatttgtttgaaggtatactgtagagtttttattgctgttttgttcagtaattataggtcaaatctaattacaacaaccaagatggattgccaaactcttctgcttggttggaatttcattgtatcgcattatccaggtggctagtggcatttgataatatagagatgactttgaaactttcaaaaaggtatttctattccaatgatatttggtaattaggttgggcctataaatatagaacaaattcagggatttttaaaaaattgtgttactactgatatatgctagttttattttatttttttgaactgtcattgagtttattttagcacaagaatatttttagcctaacattattaataagaaatgtgtcaaatttttaacattggtaaaatatgttatgtgcattttgaaaacagaaaacaaattgcgttggcatgtacgtgggtgggaagaaaaagaaaattaacaggatttacacaattataatcaccagcagtgtgagtttaaaaaacttcgttgtttttacaccaaattaaaattttcatgtcaaacttcaaagccagaaagctgctaaatacgtgtctggcaggtaaaagctggaaaattacttaaaacaggaaagtgtcaataaaaaaacttgagcaacaccaacatattttttcttaaaatgtcacgttatcttcattttgggaaactaggttctataaaatatttatcctccctgttatactttggagcacagcacagccagaaaggggctgcatttgtgcccaggtcaggagcaaattgaaaaaaaaaataaagtaatacaaaaaaatcaaactataaagcaaaaacatttattaaaacctgaattaatcctttttggagggaggagtagagatatataacctgaaaatacttattctttcttatcgaattttggagcctaatatagccaggagctgctgaatttgtgcccctggattggaagcaaataaaaaaaaaaaacaa

SEQ ID NO: 16686 - DNA, 2611 bp, Homo sapiens
ggacttcaggcctttttgtgtcctgtttgctaaaggcatgcgggctacagcattcaagagagggagtcgttaacaaagggaaagagataaatgtaaataagctcacatttacagaatgagcggtttgcagtaaaaagctgcggcagcccagagtctgctactttaggctgggctaacctttccctgtaaaaaaaaaaaaaaaaaaaaaaaaaaaaaaatggataaaaatatgcacttccaaagggcgagttgcccatttacatgtttattagctaattatctacaggcatcagcacattctctcatctagcacactctttcttggggaggaaaatatttcctaccggtccatagtgtcagagtggtgaacccctgcagccagcaggcctcctgaaaaaaaagtccatgggtgacagaagattcattgacttccaattccaagattcaaattcaagcctcagacccaggttgggcaatgctactgccaataatacttgcattgttgatgattccttcaagtataatctcaatggtgctgtctacagtgttgtattcatcttgggtctgataaccaacagtgtctctctgtttgtcttctgtttccgcatgaaaatgagaagtgagactgctatttttatcaccaatctagctgtctctgatttgctttttgtctgtacactaccttttaaaatattttacaacttcaaccgccactggccttttggtgacaccctctgcaagatctctggaactgcattccttaccaacatctatgggagcatgctctttctcacctgtattagtgtggatcgtttcctggccattgtctatccttttcgatctcgtactattaggactaggaggaattctgccattgtgtgtgctggtgtctggatcctagtcctcagtggcggtatttcagcctctttgttttccaccactaatgtcaacaatgcaaccaccacctgctttgaaggcttctccaaacgtgtctggaagacttatttatccaagatcacaatatttattgaagttgttgggtttatcattcctctaatattgaatgtctcttgctcttctgtggtgctgagaactcttcgcaagcctgctactctgtctcaaattgggaccaataagaaaaaagtactgaaaatgatcacagtacatatggcagtctttgtggtatgctttgtaccctacaactctgtcctcttcttgtatgccctggtgcgctcccaagctattactaattgctttttggaaagatttgcaaagatcatgtacccaatcaccttgtgccttgcaactctgaactgttgttttgaccctttcatctattacttcacccttgaatcctttcagaagtccttctacatcaatgcccacatcagaatggagtccctgtttaagactgaaacacctttgaccacaaagccttcccttccagctattcaagaggaagtgagtgatcaaacaacaaataatggtggtgaattaatgctagaatccaccttttaggtatgagaaatgtgttcaggtccagatatggtttctcctataatttttcctatgctataaactaaagatttgaagctaatgatactgagaataatgcaccaaatccagtcagatacatttgtttgaaggtatactgtagagtttttattgctgttttgttcagtaattataggtcaaatctaattacaacaaccaagatggattgccaaactcttctgcttggttggaatttcattgtatcgcattatccaggtggctagtggcatttgataatatagagatgactttgaaactttcaaaaaggtatttctattccaatgatatttggtaattaggttgggcctataaatatagaacaaattcagggatttttaaaaaattgtgttactactgatatatgctagttttattttatttttttgaactgtcattgagtttattttagcacaagaatatttttagcctaacattattaataagaaatgtgtcaaatttttaacattggtaaaatatgttatgtgcattttgaaaacagaaaacaaattgcgttggcatgtacgtgggtgggaagaaaaagaaaattaacaggatttacacaattataatcaccagcagtgtgagtttaaaaaacttcgttgtttttacaccaaattaaaattttcatgtcaaacttcaaagccagaaagctgctaaatacgtgtctggcaggtaaaagctggaaaattacttaaaacaggaaagtgtcaataaaaaaacttgagcaacaccaacatattttttcttaaaatgtcacgttatcttcattttgggaaactaggttctataaaatatttatcctccctgttatactttggagcacagcacagccagaaaggggctgcatttgtgcccaggtcaggagcaaattgaaaaaaaaaataaagtaatacaaaaaaatcaaactataaagcaaaaacatttattaaaacctgaattaatcctttttggagggaggagtagagatatataacctgaaaatacttattctttcttatcgaattttggagcctaatatagccaggagctgctgaatttgtgcccctggattggaagc

SEQ ID NO: 16687 - DNA, 3171 bp, Homo sapiens
agtgggaggcaggacctagcagagcactgtcatgaagagggccccgggcagggtggggcacaagccacgagtggcatggactaagccacgagtagcatggactaaaccacctggcagacctaggaaaggaagacagacacccagggggaaccggtgaggacagcgagaggctggtgggttagtcatctggcatcagacggtgggtgtgccaggaagagttcccagacacagcaggaatatctgaacgatgggtgggggcagttcctagtcggggctggattaagtatccttagctgctggggtttcttctctggccagtccgtgaaggcctctgagggcaatgcttcctcttcactctctccttggcccgtgtggggttgggtgagtgcactgagctgggagggatgggctgagatctgctgaggtgggtgtgtcccctcccgccctgggagcaggtcctaccagcccagcccagcccagcccagcccagagcaggcagcggaagccagcttggggcagcgcagagcaacacggagcacaggtctctgctgctgatgaagctgtgaccaaacgcacccaacccttggcagccatctgtccctgcagccatagcccacattcccatgacctccctctgcttgttttgggaccatgtctgtacagcctctaggccccagccccggaggtgaatgccatgccatgattctggtgtgctccatggcatccccagcctagctcccaatcccactttggcacgatgttagccaacagctcctcaaccaacagttctgttctcccgtgtcctgactaccgacctacccaccgcctgcacttggtggtctacagcttggtgctggctgccgggctccccctcaacgcgctagccctctgggtcttcctgcgcgcgctgcgcgtgcactcggtggtgagcgtgtacatgtgtaacctggcggccagcgacctgctcttcaccctctcgctgcccgttcgtctctcctactacgcactgcaccactggcccttccccgacctcctgtgccagacgacgggcgccatcttccagatgaacatgtacggcagctgcatcttcctgatgctcatcaacgtggaccgctacgccgccatcgtgcacccgctgcgactgcgccacctgcggcggccccgcgtggcgcggctgctctgcctgggcgtgtgggcgctcatcctggtgtttgccgtgcccgccgcccgcgtgcacaggccctcgcgttgccgctaccgggacctcgaggtgcgcctatgcttcgagagcttcagcgacgagctgtggaaaggcaggctgctgcccctcgtgctgctggccgaggcgctgggcttcctgctgcccctggcggcggtggtctactcgtcgggccgagtcttctggacgctggcgcgccccgacgccacgcagagccagcggcggcggaagaccgtgcgcctcctgctggctaacctcgtcatcttcctgctgtgcttcgtgccctacaacagcacgctggcggtctacgggctgctgcggagcaagctggtggcggccagcgtgcctgcccgcgatcgcgtgcgcggggtgctgatggtgatggtgctgctggccggcgccaactgcgtgctggacccgctggtgtactactttagcgccgagggcttccgcaacaccctgcgcggcctgggcactccgcaccgggccaggacctcggccaccaacgggacgcgggcggcgctcgcgcaatccgaaaggtccgccgtcaccaccgacgccaccaggccggatgccgccagtcaggggctgctccgaccctccgactcccactctctgtcttccttcacacagtgtccccaggattccgccctctgaacacacatgccattgcgctgtccgtgcccgactcccaacgcctctcgttctgggaggcttacagggtgtacacacaagaaggtgggctgggcacttggacctttgggtggcaattccagcttagcaacgcagaagagtacaaagtgtggaagccagggcccagggaaggcagtgctgctggaaatggcttctttaaactgtgagcacgcagagcaccccttctccagcggtgggaagtgatgcagagagcccacccgtgcagagggcagaagaggacgaaatgcctttgggtgggcagggcattaaactgctaaaagctggttagatggaacagaaaatgggcattctggatctaaaccgccacaggggcctgagagctgaagagcaccaggtttggtggacaaagctactgagatgcctgttcatctgctgacttctgtctaggctcatggatgccaccccctttcatttcggcctaggcttcccctgctcaccactgaggcctaatacaagagttcctatggacagaactacattctttctcgcatagtgacttgtgacaatttagacttggcatccagcatgggatagttggggcaaggcaaaactaacttagagtttccccctcaacaacatccaagtccaaaccctttttaggttatcctttcttccatcacatccccttttccaggcctcctccattttaggtccttaatattctttctttttctctctctctcgtttctctcttctctctcctctcctctcctctctcttctcctcttctctctctctccctctctctcctttgtccagagtaaggataaaattctttctactaaagcactggttctcaaactttttggtctcagaccccactcttagaaattgaggatctcaaagagctttgcttatattttgttcttttgatacttaccatactagaaattaaagcgaatacatttttaaaataaatacacatgcacacattacattagccatgggagcaataatgtcaccacacacacttcatgaagcctctggaaaactctacagtatacttgtgagagaatgagagtgaaagggacaaataacatctgtgtagcagtattatgaaaatagcttgacctcgtggacttcctcagagggttggtccctggatcacactttgagaaccatacttgtcctgaagtattggagttcatgtctaacttcttcccagggcattatgtacagtgctttttattactgtggggagagggcagtgctaaataaattaatcactactgatagtc

SEQ ID NO: 16688 - DNA, 2695 bp, Homo sapiens
agcaaagagcagtgcccagcccagctcagagggcaaatgggacagatcccagaggccctgaggaggtctctgctgctgatgaagctgtgaccaaacgcacccaacccttggcagccatctgtccctgcagccatagcccacattcccatgacctccctctgcttgttttgggaccatgtctgtacagcctctaggccccagccccggaggtgaatgccatgccatgattctggtgtgctccatggcatccccagcctagctcccaatcccactttggcacgatgttagccaacagctcctcaaccaacagttctgttctcccgtgtcctgactaccgacctacccaccgcctgcacttggtggtctacagcttggtgctggctgccgggctccccctcaacgcgctagccctctgggtcttcctgcgcgcgctgcgcgtgcactcggtggtgagcgtgtacatgtgtaacctggcggccagcgacctgctcttcaccctctcgctgcccgttcgtctctcctactacgcactgcaccactggcccttccccgacctcctgtgccagacgacgggcgccatcttccagatgaacatgtacggcagctgcatcttcctgatgctcatcaacgtggaccgctacgccgccatcgtgcacccgctgcgactgcgccacctgcggcggccccgcgtggcgcggctgctctgcctgggcgtgtgggcgctcatcctggtgtttgccgtgcccgccgcccgcgtgcacaggccctcgcgttgccgctaccgggacctcgaggtgcgcctatgcttcgagagcttcagcgacgagctgtggaaaggcaggctgctgcccctcgtgctgctggccgaggcgctgggcttcctgctgcccctggcggcggtggtctactcgtcgggccgagtcttctggacgctggcgcgccccgacgccacgcagagccagcggcggcggaagaccgtgcgcctcctgctggctaacctcgtcatcttcctgctgtgcttcgtgccctacaacagcacgctggcggtctacgggctgctgcggagcaagctggtggcggccagcgtgcctgcccgcgatcgcgtgcgcggggtgctgatggtgatggtgctgctggccggcgccaactgcgtgctggacccgctggtgtactactttagcgccgagggcttccgcaacaccctgcgcggcctgggcactccgcaccgggccaggacctcggccaccaacgggacgcgggcggcgctcgcgcaatccgaaaggtccgccgtcaccaccgacgccaccaggccggatgccgccagtcaggggctgctccgaccctccgactcccactctctgtcttccttcacacagtgtccccaggattccgccctctgaacacacatgccattgcgctgtccgtgcccgactcccaacgcctctcgttctgggaggcttacagggtgtacacacaagaaggtgggctgggcacttggacctttgggtggcaattccagcttagcaacgcagaagagtacaaagtgtggaagccagggcccagggaaggcagtgctgctggaaatggcttctttaaactgtgagcacgcagagcaccccttctccagcggtgggaagtgatgcagagagcccacccgtgcagagggcagaagaggacgaaatgcctttgggtgggcagggcattaaactgctaaaagctggttagatggaacagaaaatgggcattctggatctaaaccgccacaggggcctgagagctgaagagcaccaggtttggtggacaaagctactgagatgcctgttcatctgctgacttctgtctaggctcatggatgccaccccctttcatttcggcctaggcttcccctgctcaccactgaggcctaatacaagagttcctatggacagaactacattctttctcgcatagtgacttgtgacaatttagacttggcatccagcatgggatagttggggcaaggcaaaactaacttagagtttccccctcaacaacatccaagtccaaaccctttttaggttatcctttcttccatcacatccccttttccaggcctcctccattttaggtccttaatattctttctttttctctctctctcgtttctctcttctctctcctctcctctcctctctcttctcctcttctctctctctccctctctctcctttgtccagagtaaggataaaattctttctactaaagcactggttctcaaactttttggtctcagaccccactcttagaaattgaggatctcaaagagctttgcttatattttgttcttttgatacttaccatactagaaattaaagcgaatacatttttaaaataaatacacatgcacacattacattagccatgggagcaataatgtcaccacacacacttcatgaagcctctggaaaactctacagtatacttgtgagagaatgagagtgaaagggacaaataacatctgtgtagcagtattatgaaaatagcttgacctcgtggacttcctcagagggttggtccctggatcacactttgagaaccatacttgtcctgaagtattggagttcatgtctaacttcttcccagggcattatgtacagtgctttttattactgtggggagagggcagtgctaaataaattaatcactactgatagtc

SEQ ID NO: 16689 - DNA, 2275 bp, Homo sapiens
agtgctgaggaagctgagggcagaacccagctgggagattggtaactccactctgaagaatagcttccaagaacttggaggtttccaacccaggtctgtgacagccttgggcggcgacacatgtctacctgtgccctctgtgacttctgctccttgaagctggagcagtgccactcagaggccagcctgcagcggcaacaatgcgacacctcccacaagactccctttgtcagccccttgcttgcctcccagagcctgtccatcggcaaccaggtagggtccccagaatcaggccgcttttacgggctggatttgtacggtgggctccacatggacttctggtgtgcccggcttgccacgaaaggctgtgaagatgtccgagtctctgggtggctccagactgagttccttagcttccaggatggggatttccctaccaagatttgtgacacagactatatccagtacccaaactactgttccttcaaaagccagcagtgtctgatgagaaaccgcaatcggaaggtctctgctgctgatgaagctgtgaccaaacgcacccaacccttggcagccatctgtccctgcagccatagcccacattcccatgacctccctctgcttgttttgggaccatgtctgtacagcctctaggccccagccccggaggtgaatgccatgccatgattctggtgtgctccatggcatccccagcctagctcccaatcccactttggcacgatgttagccaacagctcctcaaccaacagttctgttctcccgtgtcctgactaccgacctacccaccgcctgcacttggtggtctacagcttggtgctggctgccgggctccccctcaacgcgctagccctctgggtcttcctgcgcgcgctgcgcgtgcactcggtggtgagcgtgtacatgtgtaacctggcggccagcgacctgctcttcaccctctcgctgcccgttcgtctctcctactacgcactgcaccactggcccttccccgacctcctgtgccagacgacgggcgccatcttccagatgaacatgtacggcagctgcatcttcctgatgctcatcaacgtggaccgctacgccgccatcgtgcacccgctgcgactgcgccacctgcggcggccccgcgtggcgcggctgctctgcctgggcgtgtgggcgctcatcctggtgtttgccgtgcccgccgcccgcgtgcacaggccctcgcgttgccgctaccgggacctcgaggtgcgcctatgcttcgagagcttcagcgacgagctgtggaaaggcaggctgctgcccctcgtgctgctggccgaggcgctgggcttcctgctgcccctggcggcggtggtctactcgtcgggccgagtcttctggacgctggcgcgccccgacgccacgcagagccagcggcggcggaagaccgtgcgcctcctgctggctaacctcgtcatcttcctgctgtgcttcgtgccctacaacagcacgctggcggtctacgggctgctgcggagcaagctggtggcggccagcgtgcctgcccgcgatcgcgtgcgcggggtgctgatggtgatggtgctgctggccggcgccaactgcgtgctggacccgctggtgtactactttagcgccgagggcttccgcaacaccctgcgcggcctgggcactccgcaccgggccaggacctcggccaccaacgggacgcgggcggcgctcgcgcaatccgaaaggtccgccgtcaccaccgacgccaccaggccggatgccgccagtcaggggctgctccgaccctccgactcccactctctgtcttccttcacacatgccattgcgctgtccgtgcccgactcccaacgcctctcgttctgggaggcttacagggtgtacacacaagaaggtgggctgggcacttggacctttgggtggcaattccagcttagcaacgcagaagagtacaaagtgtggaagccagggcccagggaaggcagtgctgctggaaatggcttctttaaactgtgagcacgcagagcaccccttctccagcggtgggaagtgatgcagagagcccacccgtgcagagggcagaagaggacgaaatgcctttgggtgggcagggcattaaactgctaaaagctggttagatggaacagaaaatgggcattctggatctaaaccgccacaggggcctgagagctgaagagcaccaggtttggtggacaaagctactgagatgcctgttcatctgctgacttctgtctaggct

SEQ ID NO: 16690 - DNA, 3966 bp, Homo sapiens
cgcgcctgcgcgcccggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtcacgctgccacccgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataagtaaaacataaagtctatacttgggaatgat

SEQ ID NO: 16691 - DNA, 5610 bp, Homo sapiens
ggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtcacgctgccacccgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggagaaagacaacaacaggcattgtgagaggagagccaatccagatgagattttcttggtgtggttctagcatgtttggaaaacacaagaattgaaattctgtagaaaaagctgtcttggtggcaaagggacgctccggagtgttctggtattttgcggacagtagcagacatcttacagagttgaaacatggatggctggctgcctgcctgttctccactcagcattggagccaggagaaatgaaggtgggaccctcaggaaaaagcaaacccacccccggtgttcacgcaagagttgacacagctgcacctgctgctgccgtatgctgatcctaaccagaagctggctgggaggagaggccccctgggccatgaagcagagctcgggaatgtgagaagtggggctgagggcaaacggggtagtgaaggaccagcactgcccacccatagctgctctgtgtccacaagcaggtcagctgcagctctgctccatgtcaccatctgcatccagcccagcacagcagcccctcctgggactcagccagtcagatggctttgggaagaggtgacaagcaagcctgcctagatgctatatctgctgcacagacgcagaatacagcaggcccactcctggttcattggccacagtaagccatgtggtcacagctgaattcaacagccagagacgtacagtcctgcaagggagcccctcaaaggaggtgaaggatcttctgaacagcagcaccagccaccctgcagtaagtgttggatgtggtggtgagcagggccagtcctaattccacccattgacattacagacattattctggctatgaaatggtgccatgtcttggtccacagttcgaggcactatgtcatccatcaggatggcagtccaatgttctagggcactgcctccccatgggcagcacacctaaagcttcaagaagtcatcctcatgcttaatcagactcgccacctctgggtgatgggaaacgtagggattccaagtgtgtacctgttcccatgctgcctttgctgtaaagtaaattccttaacaatgccataggaggtgggcaatagtgaataagccattcatcaagcccacagatggtgctgtcagaaacactgacagcaaagacatatccatatctggaataagggaaactgaaaccaagagatactcccctcaatgatggaagagtccagtgtgatcaacctgcctccagggggctggctagtccctttcccaggaatggtacctggggctaagtatgggaccctgcttccgacatgttgggagtccagtgataactgcatcagcctaggctattgttgatgggtcagctctttgttattgatccacactcatctccatccctatttccagtgccagtttgtgaatggttctactaggtaaacactgggttggctgggaaagagacaggctgacatccactgcctgtgtcataccctggcagagactatagtaaattagacccgacaagagaaaatattagtgaacctgaaaatacagctatgtgtgatcccagtgatgtacagggagaaacagacagaaatgaagcacaagtgggcatggaataatgccacaaggcccatcacatgtgattggagccctagaaaaggaggaggacaggacagaaaaattatttgatgaaataatggccagaatttttttccaaatctataaactaagatacccaagaagctcaataagcacccagcagaaaaaatacaataaaaacacagcaagacacacatcacaaactgctgaaagccactgaaaaggagaaaaatcttaaaagcagctggagaaaaacaacatactatcaaggaacagagataagaatgaaagccaacttctcttcagaaactatgcaacccagacgtcaaggaacagagataagaacgacagccgacttctctgcagaaactatgcaacccagacgtcaaggaacagagataagaacgacagccgacttctctgcagaaactatgcaacccagacgtcaaggaacagagataagaacgacagccgacttctctgcagaaactatg

SEQ ID NO: 16692 - DNA, 2268 bp, Homo sapiens
ccggaattgggggtgaagcgatagcgttttgcccgcattcggggcgcgcggagctggggggtccctgtggggctcccggagttaagatggcgtcctcagcggagggggacgaggggactgtggtggcgctggcgggggttctgcagtcgggtttccaggagctgagccttaacaagttggcgacgtccctgggcgcgtcagaacaggcgctgcggctgatcatctccatcttcctgggttacccctttgctttgttttatcggcattaccttttctacaaggagacctacctcatccacctcttccatacctttacaggcctctcaattgcttattttaactttggaaaccagctctaccactccctgctgtgtattgtgcttcagttcctcatccttcgactaatgggccgcaccatcactgccgtcctcactaccttttgcttccagatggcctaccttctggctggatactattacactgccaccggcaactacgatatcaagtggacaatgccacattgtgttctgactttgaagctgattggtttggctgttgactactttgacggagggaaagatcagaattccttgtcctctgagcaacagaaatatgccatacgtggtgttccttccctgctggaagttgctggtttctcctacttctatggggccttcttggtagggccccagttctcaatgaatcactacatgaagctggtgcagggagagctgattgacataccaggaaagataccaaacagcatcattcctgctctcaagcgcctgagtctgggccttttctacctagtgggctacacactgctcagcccccacatcacagaagactatctcctcactgaagactatgacaaccaccccttctggttccgctgcatgtacatgctgatctggggcaagtttgtgctgtacaaatatgtcacctgttggctggtcacagaaggagtatgcattttgacgggcctgggcttcaatggctttgaagaaaagggcaaggcaaagtgggatgcctgtgccaacatgaaggtgtggctctttgaaacaaacccccgcttcactggcaccattgcctcattcaacatcaacaccaacgcctgggtggcccgctacatcttcaaacgactcaagttccttggaaataaagaactctctcagggtctctcgttgctattcctggccctctggcacggcctgcactcaggatacctggtctgcttccagatggaattcctcattgttattgtggaaagacaggctgccaggctcattcaagagagccccaccctgagcaagctggccgccattactgtcctccagcccttctactatttggtgcaacagaccatccactggctcttcatgggttactccatgactgccttctgcctcttcacgtgggacaaatggcttaaggtgtataaatccatctatttccttggccacatcttcttcctgagcctactattcatattgccttatattcacaaagcaatggtgccaaggaaagagaagttaaagaagatggaataatccatttccctggtggcctgtgcgggactggtgcagaaactactcgtctcccttttcacagcactcctttgccccagagcagagaatggaaaagccagggaggtggaagatcgatgcttccagctgtgcctctgctgccagccaagtcttcatttggggccaaaggggaaacttttttttggagaaggcgtcttgctttgtcacccacgctggaatgcagtggcgggatctcagctcaccgcaacctccacctcctgggttcaagtgattttcctgcctcagcctcccaagtagctgggaatacaggcacgccaccatgcccagctaatttttgtattttcagtagaaacgggatttcaccacgttggccaggctggtctcgaactcctgaccgcaagtgatccacccgcctccgcctcccaaagtgctgggattacaggcgtgagccaccgtgcccggcccaaaggggaaactcttgtgggaggagcagaggggctcacatctcccctctgattcccccatgcacattgccttatctctccccatctagccaggaatctattgtgtttttcttctgccaatttactatgattgtgtatgtgccgctaccaccaccccccccatgggggggtggagaggggtgcaaggccctgcctgctccactttttctaccttggaactgtattagataaaatcacttctgtttgttcagtttttc

SEQ ID NO: 16693 - DNA, 1971 bp, Homo sapiens
ggcgccctgacaacgcgggcgggctgggctgcgccgcctgctccccgcccctcggccgcctgcaccgggcggggcccgggccagagcgccgccgccgccgctgctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 16694 - DNA, 2574 bp, Homo sapiens
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagtttgttttttctttattgtccttcatagcaggccaagtattgcctctctgcaatagacagctactgtcaatacatgctgtaatttgacattctgggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 16695 - DNA, 1308 bp, Homo sapiens
ggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaa

SEQ ID NO: 16696 - DNA, 2212 bp, Homo sapiens
atggagttacacgaacggccagatgaaagaaggaaggcccggacctccactcagggccgactaggggactggcggagggtgcacgctgatggatttactcaccgggtgtggagctccagcagctggctggagcccgcgatgacgtcacggactcgggtcacatggccaagtccgccccgccccctccccgtccccgccgctgcagcggtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctggaacactgtgatagattaactgtagaattcttcctgtacgattggggatataatgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagttgtttgcaattaaaacaaggtttgcccac

SEQ ID NO: 16697 - DNA, 3173 bp, Homo sapiens
atcctattttctgggaaaagattactaccacagtaattgagctgtgaagcggagacaaattgctctcggtggtggttcaaagtactgcaattgactggaatagcaccgcgcagttttccttcctctcgtgcaagataagagtgataggagctgtatcgattacctgcaagatagaagtagaagcgggccgggtgcggtggctcacgcctgtaatcccagcactttgggaggctgaggcgggtggatcattcgacgtcaggagttccagaccagcctgaccaacatggtgaaaccccgtctctactaaaaatacaacaaattagccgggtgtggtggcaagcgcctgtaatcccagctactcggttggttgggcaggagaatcgcttgaacccgggaggcggaggttgcagtgagccgagatcgcgccattgcactccagcctgggcgacaagagcgagactctgtctcaaaaaaaaaaaaaaaagaagtagaagggaagaaaatcgcaaggaactagactaaaagaatctcgacccttgaatggagttacacgaacggccagatgaaagaaggaaggcccggacctccactcagggccgactaggggactggcggagggtgcacgctgatggatttactcaccgggtgcttggagctccagcagctggctggagcccgcgatgacgtcacggactcgggtcacatggccaagtccgccccgccccctccccgtccccgccgctgcagcggtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctggaacactgtgatagattaactgtagaattcttcctgtacgattggggatataatgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagttgtttgcaattaaaacaaggtttgcccacatccaagatgaccttgtgattttgtgctgattgtgtctgaggacctttccctccacatatggtctggcagatgcacccagttcagcctaaggagtaggcttttttttgggggggggaggtcgggtgggggggatttttaatcttttaattttcaagatggttaaaatattgaaatgtttaagtggataactatattattcataaaatgactgagtgaaaactaatacactatgagatgaaaagtacttgtcagggattttcaagcttttgctcaagtaattactatgaaataacaatttctagaaatgaagaacaatccgtggagaataaattaccattggtgtgggggaaaaaagccaaacagaagtagaaaaaggtgtagccggcatacaaatgttatctacagtgtatttttagat

SEQ ID NO: 16698 - DNA, 681 bp, Homo sapiens
atgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaa

SEQ ID NO: 16699 - DNA, 2223 bp, Homo sapiens
cttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcagtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcataacagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttc

SEQ ID NO: 16700 - DNA, 986 bp, Homo sapiens
agtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcagtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagt

SEQ ID NO: 16701 - DNA, 13471 bp, Homo sapiens
gcggcggcggcagcggcgtcggctcggggttctccgggagagggggagtgcgcggcggccgcagctgccacaaaccaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgaagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacagaaaaaggaaagaagataaagaaaagaaacaaatcattaattttaccagatagcagttttgatggtacagagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggaagcctgatgttactttggattttatgcttccaagaaaaacaagtttgtcatctgatagcaataaaacattttgcatgattggccattgtttatcatcccaagaagagtttttgcagttggctggaaaatgggacctgggaaatttgcttctcttcaacggagctaaggttggttcacaagaggccttttatctgtatgcttgtggacccaaccatacatctgtaatgccatgtaagtatggcaagccagtcaatgactactccaaatatattaataaagaaattttgcgatgtgaacaaatcagagaactttttatgaccaagaaagatgtggatattggtctcttaattgaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaagacccttcttgaaggatgctgtggtgaagatattatttatatgaatgagaatggagagtttaagttggatgtagactctaatgctataatccaagatgttaagctgttagaggaactattgcttgactggaagatatggagtaaagcagagcaaggtgtttgggaaactttgctagcagctctagaagtcctcatcagagcagatcaccaccagcagatgtttaatattaagcagttattgaaagctcaagtggttcatcactttctactgacttgtcaggttttgcaggaatacaaagaggggcaactcacacccatgccccgagaggtttgtagatcatttgtgaaaattatagcagaagtccttggatctcctccagatttggaattattgacaattatcttcaatttccttttagcagttcaccctcctactaatacttacgtttgtcacaatcccacgaacttctacttttctttgcacatagatggcaagatctttcaggagaaagtgcggtcaatcatgtacctgaggcattccagcagtggaggaaggtcccttatgagccctggatttatggtaataagcccatctggttttactgcttcaccatatgaaggagagaattcctctaatattattccacaacagatggccgcccatatgctgcgttctagaagcctaccagcattccctacttcttcactactaacgcaatcacaaaaactgactggaagtttgggttgtagtatcgacaggttacaaaatattgcagatacttatgttgccacccaatcaaagaaacaaaattctttggggagttccgacacactgaaaaaaggcaaagaggacgcattcatcagtagctgtgagtctgcaaaaactgtttgtgaaatggaagctgtcctctcagcccaggtctctgtcagtgatgtcccaaagggagtgctgggatttccagtggtcaaagcagatcataaacagttgggagcagaacccaggtcagaagatgacagtcctggggatgagtcctgcccacgccgacctgattacctaaagggattggcctccttccagcgaagccacagcactattgcaagccttgggctagcttttccttcacagaacggatctgcagctgttggccgttggccaagtcttgttgatagaaacactgatgattgggaaaactttgcctattctcttggttatgagccaaattacaaccgaactgcaagtgctcacagtgtaactgaagactgtttggtacctatatgctgtggattatatgaactcctaagtggggttcttcttatcctgcctgatgttttgcttgaagatgtgatggacaagcttattcaagcagatacacttttggtcctcgttaaccacccatcaccagctatacaacaaggtgttattaaactattagatgcatattttgctagagcatctaaggaacaaaaagataaatttctgaagaatcgtggattttccttgctagccaaccagttgtatcttcatcgaggaactcaagaattgttagaatgcttcatcgaaatgttctttggtcgacatattggccttgatgaagaatttgatctggaagatgtgagaaacatgggattgtttcagaagtggtctgtcattcctattctgggactaatagagacctctctatatgacaacatactcttgcataatgctcttttacttcttctccaaattttaaattcttgttctaaggtagcagatatgttgctggataatggtctactctatgtgttatgtaatacagtagcagccctgaatggattagaaaagaacattcccatgagtgaatataaattgcttgcttgtgatatacagcaacttttcatagcagttacaattcatgcttgcagttcctcaggctcacaatattttagggttattgaagaccttattgtaatgcttggatatcttcaaaatagcaaaaacaagaggacacaaaatatggctgttgcactacagcttagagttctccaggctgctatggaatttataaggaccaccgcaaatcatgactctgaaaacctcacagattcactccagtcaccttctgctccccatcatgcagtagttcaaaagcggaaaagcattgctggtcctcgaaaatttccccttgctcaaactgaatcgcttctgatgaaaatgcgttcagtggcaaatgatgagcttcatgtgatgatgcaacggagaatgagccaagagaaccctagccaagcaactgaaacggaacttgcgcagagactacagaggctcactgttttagcagtcaacaggattatttatcaagaatttaattcagacattattgacattttgagaactccagaaaatgtaactcaaagcaagacctcagttttccagaccgaaatttctgaggaaaatattcatcatgaacagtcttctgttttcaatccatttcagaaagaaatttttacatatctggtagaaggattcaaagtatctattggttcaagtaaagccagtggttccaagcagcaatggactaaaattctgtggtcttgtaaggagaccttccgaatgcagcttgggagactactagtgcatattttgtcgccagcccacgctgcacaagagagaaagcaaatttttgaaatagttcatgaaccaaatcatcaggaaatactacgagactgtctcagcccatccctacaacatggagccaagttagttttgtatttgtcagagttgatacataatcaccaaggtgaattgactgaagaagagctaggcacagcagaactgcttatgaatgctttgaagttatgtggtcacaagtgcatccctcccagtgcatcaacaaaagcagaccttattaaaatgatcaaagaggaacaaaagaaatatgaaactgaagaaggagtgaataaagctgcttggcagaaaacagttaacaataatcaacaaagtctctttcagcgtctggattcaaaatcaaaggatatatctaaaatagctgcagatatcacccaggcagtgtctctctcccaaggaaatgagagaaaaaaggtgatccagcatattagaggaatgtataaagtagatttgagtgccagcagacattggcaggaacttattcagcagctgacacatgatagagcagtatggtatgaccccatctactatccaacctcatggcagttggatccaacagaagggccaaatcgagagaggagacgtttacagagatgttatttaactattccaaataagtatctccttagggatagacagaaatcagaagatgttgtcaaaccaccactctcttacctgtttgaagacaaaactcattcttctttctcttctactgtcaaagacaaagctgcaagtgaatctataagagtgaatcgaagatgcatcagtgttgcaccatctagagagacagctggtgaattgttactaggtaaatgtggaatgtattttgtggaagataatgcttctgatacagttgaaagttcgagccttcagggagagttggaaccagcatcattttcctggacatatgaagaaattaaagaagttcacaagcgttggtggcaattgagagataatgctgtagaaatctttctaacaaatggcagaacactcctgttggcatttgataacaccaaggttcgtgatgatgtataccacaatatactcacaaataacctccctaatcttctggaatatggtaacatcaccgctctgacaaatttatggtatactgggcaaattactaattttgaatatttgactcacttaaacaaacatgctggccgatccttcaatgatctcatgcagtatcctgtgttcccatttatacttgctgactacgttagtgagacacttgacctcaatgatctgttgatatacagaaatctctctaaacctatagctgttcagtataaagaaaaagaagatcgttatgtggacacatacaagtacttggaggaagagtaccgcaaaggagccagagaagatgaccccatgcctcccgtgcagccctatcactatggctcccactattccaatagcggcactgtgcttcacttcctggtcaggatgcctcctttcactaaaatgtttttagcctatcaagatcaaagttttgacattccagacagaacttttcattctacaaatacaacttggcgactctcatcttttgaatctatgactgatgtgaaagaacttatcccagagtttttctatcttccagagttcctagttaaccgtgaaggttttgattttggtgtgcgtcagaatggtgaacgggttaatcacgtcaaccttcccccttgggcgcgtaatgatcctcgtctttttatcctcatccatcggcaggctctagagtctgactacgtgtcgcagaacatctgtcagtggattgacttggtgtttgggtataagcaaaaggggaaggcttctgttcaagcgatcaatgtttttcatcctgctacatattttggaatggatgtctctgcagttgaagatccagttcagagacgagcgctagaaaccatgataaaaacctacgggcagactccccgtcagctgttccacatggcccatgtgagcagacctggagccaagctcaatattgaaggagagcttccagctgctgtggggttgctagtgcagtttgctttcagggagacccgagaacaggtcaaagaaatcacctatccgagtcctttgtcatggataaaaggcttgaaatggggggaatacgtgggttcccccagtgctccagtacctgtggtctgcttcagccagccccacggagaaagatttggctctctccaggctctgcccaccagagcaatctgtggtttgtcacggaatttctgtcttctgatgacatatagcaaggaacaaggtgtgagaagcatgaacagtacggacattcagtggtcagccatcctgagctggggatatgctgataatattttaaggttgaagagtaaacaaagtgagcctccagtaaactttattcaaagttcacaacagtaccaggtgactagttgtgcttgggtgcctgacagttgccagctgtttactggaagcaaatgcggtgtcatcacagcctacacaaacagatttacaagcagcacgccatcagaaatagaaatggagactcaaatacatctctatggtcacacagaagagataaccagcttatttgtttgcaaaccatacagtatactgataagtgtgagcagagacggaacctgcatcatatgggatttaaacaggttatgctatgtacaaagtctggcgggacacaaaagccctgtcacagctgtctctgccagtgaaacctcaggtgatattgctactgtgtgtgattcagctggcggaggcagtgacctcagactctggacggtgaacggggatctcgttggacatgtccactgcagggagatcatctgttccgtggctttctccaaccagcctgagggagtatctatcaatgtaatcgctgggggattagaaaatggaattgtaaggttatggagcacatgggacttaaagcctgtgagagaaattacatttcccaaatcaaataagcccatcatcagccttacattttcttgtgatggccaccatttgtacacagcaaacagtgatgggaccgtgattgcctggtgtcggaaggaccagcagcgcttgaaacagccaatgttctattccttccttagcagctatgcagccgggtgaatgcgaatgaacttcacgttctccaaagcactttaactccaaactagatttgttgacttcaccagttttaggaggttgaacctaaagaaatggatgactggacaaaccatccaaataatgataaagtctattcatctgcacaaaattctgaagagtcacatgatcctaagaggaaagttctgttctattttagtgataatctggaagattgtgtcaatatgcactagccaacaagttttaagcctcgcatggtacattaaaatgatattcttaaaattttttcccaccaaggtattccaaagaaaatattaaggtctcccctttttctatgattccaaaaggaccagtagaatttaaattggttggttgattgtttatataaaacacactaaaattatattttaaaagtttactgccatgaaatactcctcccaccacacacacatgctccaaaagaggaaagaaaaaaagataatttttaggacttgataattgctttctttgagaagcaaattattcagtaggtgcctctgtaccaaatattttatggaatatctaaatactaaaataaactatgaatgaatctcaaaattaggcagtttttgccagttgctttcttagctcaaaggagaaccagaatttttttgacagccacaaacaagaatacaggtatcttggatttcagacacattctgtttcttcataaaaattttacttaaaatctgtaacgctagatattgactatccttagttgagtcactgaggtttaaacacaatggtaagtcttaaagtctgctatttacagagcattgaatctgtaccaatttgcaatagaaagccttcagtatgcaagaagtttgcatgggtattaagaacacagcctaaataaggcatttgatctaatctgcaggaagaattttcttccccaaaacagaattataaaagcttactttaaacaggaggcagaataattcttttaggaaaccatttcattctgtttctactaacctataccatctgagaattctaggaagaataataaaatctcgtgtattccacagcaaacttacataccataaagacagaattcctaaacatcttggagccgtctgtctctcccatatgatggctgtctgtatatttttacttggggtgctgctttattggctttgaaaacactgtcagataagctcagtaatatgttaccatgggataaaaatatgtatccctgcctaagaataacttgtgcatttgttatggaaatttaattcatatggtgtttacagtactacttttgtaacttccagactttctaaaacattctgcttaaaaaccatataaaatataattccaaagtctctgctgtcaagatagattcgagagaaagcacgtggccatgtatgctttaaccttaaactgcatacacatgtagtgatacctaggctgcatttagatcaccgtgtgctcaggccaggtgtgaatcctgaggtccatggaggtgcagagatgagattactcctattcacgttgaagtgatttgctttgttaacaaaaaattgcagctattgtctagctttcatttttttactgagaactttaaattagtcccctattagaatagggttgctactcatctttttttaaaaaccgaatttcatcatttatctaaagagaaaatatgcagaataactggtcttgttaagagtgcaatattatatttttatgtaaaaataaaaattaatttggggggattatttattcagcatgaaacctaatatgtatatgtttgaaatacttcataatgtgcatgttgtagcaaacatttctgtaaattatcacaagctctgttacctttatatacactgcctcttcaatttggaaataaatttc

SEQ ID NO: 16702 - DNA, 13480 bp, Homo sapiens
gcggcggcggcagcggcgtcggctcggggttctccgggagagggggagtgcgcggcggccgcagctgccacaaaccaggtaaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgaagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacagaaaaaggaaagaagataaagaaaagaaacaaatcattaattttaccagatagcagttttgatggtacagagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggaagcctgatgttactttggattttatgcttccaagaaaaacaagtttgtcatctgatagcaataaaacattttgcatgattggccattgtttatcatcccaagaagagtttttgcagttggctggaaaatgggacctgggaaatttgcttctcttcaacggagctaaggttggttcacaagaggccttttatctgtatgcttgtggacccaaccatacatctgtaatgccatgtaagtatggcaagccagtcaatgactactccaaatatattaataaagaaattttgcgatgtgaacaaatcagagaactttttatgaccaagaaagatgtggatattggtctcttaattgaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaagacccttcttgaaggatgctgtggtgaagatattatttatatgaatgagaatggagagtttaagttggatgtagactctaatgctataatccaagatgttaagctgttagaggaactattgcttgactggaagatatggagtaaagcagagcaaggtgtttgggaaactttgctagcagctctagaagtcctcatcagagcagatcaccaccagcagatgtttaatattaagcagttattgaaagctcaagtggttcatcactttctactgacttgtcaggttttgcaggaatacaaagaggggcaactcacacccatgccccgagaggtttgtagatcatttgtgaaaattatagcagaagtccttggatctcctccagatttggaattattgacaattatcttcaatttccttttagcagttcaccctcctactaatacttacgtttgtcacaatcccacgaacttctacttttctttgcacatagatggcaagatctttcaggagaaagtgcggtcaatcatgtacctgaggcattccagcagtggaggaaggtcccttatgagccctggatttatggtaataagcccatctggttttactgcttcaccatatgaaggagagaattcctctaatattattccacaacagatggccgcccatatgctgcgttctagaagcctaccagcattccctacttcttcactactaacgcaatcacaaaaactgactggaagtttgggttgtagtatcgacaggttacaaaatattgcagatacttatgttgccacccaatcaaagaaacaaaattctttggggagttccgacacactgaaaaaaggcaaagaggacgcattcatcagtagctgtgagtctgcaaaaactgtttgtgaaatggaagctgtcctctcagcccaggtctctgtcagtgatgtcccaaagggagtgctgggatttccagtggtcaaagcagatcataaacagttgggagcagaacccaggtcagaagatgacagtcctggggatgagtcctgcccacgccgacctgattacctaaagggattggcctccttccagcgaagccacagcactattgcaagccttgggctagcttttccttcacagaacggatctgcagctgttggccgttggccaagtcttgttgatagaaacactgatgattgggaaaactttgcctattctcttggttatgagccaaattacaaccgaactgcaagtgctcacagtgtaactgaagactgtttggtacctatatgctgtggattatatgaactcctaagtggggttcttcttatcctgcctgatgttttgcttgaagatgtgatggacaagcttattcaagcagatacacttttggtcctcgttaaccacccatcaccagctatacaacaaggtgttattaaactattagatgcatattttgctagagcatctaaggaacaaaaagataaatttctgaagaatcgtggattttccttgctagccaaccagttgtatcttcatcgaggaactcaagaattgttagaatgcttcatcgaaatgttctttggtcgacatattggccttgatgaagaatttgatctggaagatgtgagaaacatgggattgtttcagaagtggtctgtcattcctattctgggactaatagagacctctctatatgacaacatactcttgcataatgctcttttacttcttctccaaattttaaattcttgttctaaggtagcagatatgttgctggataatggtctactctatgtgttatgtaatacagtagcagccctgaatggattagaaaagaacattcccatgagtgaatataaattgcttgcttgtgatatacagcaacttttcatagcagttacaattcatgcttgcagttcctcaggctcacaatattttagggttattgaagaccttattgtaatgcttggatatcttcaaaatagcaaaaacaagaggacacaaaatatggctgttgcactacagcttagagttctccaggctgctatggaatttataaggaccaccgcaaatcatgactctgaaaacctcacagattcactccagtcaccttctgctccccatcatgcagtagttcaaaagcggaaaagcattgctggtcctcgaaaatttccccttgctcaaactgaatcgcttctgatgaaaatgcgttcagtggcaaatgatgagcttcatgtgatgatgcaacggagaatgagccaagagaaccctagccaagcaactgaaacggaacttgcgcagagactacagaggctcactgttttagcagtcaacaggattatttatcaagaatttaattcagacattattgacattttgagaactccagaaaatgtaactcaaagcaagacctcagttttccagaccgaaatttctgaggaaaatattcatcatgaacagtcttctgttttcaatccatttcagaaagaaatttttacatatctggtagaaggattcaaagtatctattggttcaagtaaagccagtggttccaagcagcaatggactaaaattctgtggtcttgtaaggagaccttccgaatgcagcttgggagactactagtgcatattttgtcgccagcccacgctgcacaagagagaaagcaaatttttgaaatagttcatgaaccaaatcatcaggaaatactacgagactgtctcagcccatccctacaacatggagccaagttagttttgtatttgtcagagttgatacataatcaccaaggtgaattgactgaagaagagctaggcacagcagaactgcttatgaatgctttgaagttatgtggtcacaagtgcatccctcccagtgcatcaacaaaagcagaccttattaaaatgatcaaagaggaacaaaagaaatatgaaactgaagaaggagtgaataaagctgcttggcagaaaacagttaacaataatcaacaaagtctctttcagcgtctggattcaaaatcaaaggatatatctaaaatagctgcagatatcacccaggcagtgtctctctcccaaggaaatgagagaaaaaaggtgatccagcatattagaggaatgtataaagtagatttgagtgccagcagacattggcaggaacttattcagcagctgacacatgatagagcagtatggtatgaccccatctactatccaacctcatggcagttggatccaacagaagggccaaatcgagagaggagacgtttacagagatgttatttaactattccaaataagtatctccttagggatagacagaaatcagaagatgttgtcaaaccaccactctcttacctgtttgaagacaaaactcattcttctttctcttctactgtcaaagacaaagctgcaagtgaatctataagagtgaatcgaagatgcatcagtgttgcaccatctagagagacagctggtgaattgttactaggtaaatgtggaatgtattttgtggaagataatgcttctgatacagttgaaagttcgagccttcagggagagttggaaccagcatcattttcctggacatatgaagaaattaaagaagttcacaagcgttggtggcaattgagagataatgctgtagaaatctttctaacaaatggcagaacactcctgttggcatttgataacaccaaggttcgtgatgatgtataccacaatatactcacaaataacctccctaatcttctggaatatggtaacatcaccgctctgacaaatttatggtatactgggcaaattactaattttgaatatttgactcacttaaacaaacatgctggccgatccttcaatgatctcatgcagtatcctgtgttcccatttatacttgctgactacgttagtgagacacttgacctcaatgatctgttgatatacagaaatctctctaaacctatagctgttcagtataaagaaaaagaagatcgttatgtggacacatacaagtacttggaggaagagtaccgcaaaggagccagagaagatgaccccatgcctcccgtgcagccctatcactatggctcccactattccaatagcggcactgtgcttcacttcctggtcaggatgcctcctttcactaaaatgtttttagcctatcaagatcaaagttttgacattccagacagaacttttcattctacaaatacaacttggcgactctcatcttttgaatctatgactgatgtgaaagaacttatcccagagtttttctatcttccagagttcctagttaaccgtgaaggttttgattttggtgtgcgtcagaatggtgaacgggttaatcacgtcaaccttcccccttgggcgcgtaatgatcctcgtctttttatcctcatccatcggcaggctctagagtctgactacgtgtcgcagaacatctgtcagtggattgacttggtgtttgggtataagcaaaaggggaaggcttctgttcaagcgatcaatgtttttcatcctgctacatattttggaatggatgtctctgcagttgaagatccagttcagagacgagcgctagaaaccatgataaaaacctacgggcagactccccgtcagctgttccacatggcccatgtgagcagacctggagccaagctcaatattgaaggagagcttccagctgctgtggggttgctagtgcagtttgctttcagggagacccgagaacaggtcaaagaaatcacctatccgagtcctttgtcatggataaaaggcttgaaatggggggaatacgtgggttcccccagtgctccagtacctgtggtctgcttcagccagccccacggagaaagatttggctctctccaggctctgcccaccagagcaatctgtggtttgtcacggaatttctgtcttctgatgacatatagcaaggaacaaggtgtgagaagcatgaacagtacggacattcagtggtcagccatcctgagctggggatatgctgataatattttaaggttgaagagtaaacaaagtgagcctccagtaaactttattcaaagttcacaacagtaccaggtgactagttgtgcttgggtgcctgacagttgccagctgtttactggaagcaaatgcggtgtcatcacagcctacacaaacagatttacaagcagcacgccatcagaaatagaaatggagactcaaatacatctctatggtcacacagaagagataaccagcttatttgtttgcaaaccatacagtatactgataagtgtgagcagagacggaacctgcatcatatgggatttaaacaggttatgctatgtacaaagtctggcgggacacaaaagccctgtcacagctgtctctgccagtgaaacctcaggtgatattgctactgtgtgtgattcagctggcggaggcagtgacctcagactctggacggtgaacggggatctcgttggacatgtccactgcagggagatcatctgttccgtggctttctccaaccagcctgagggagtatctatcaatgtaatcgctgggggattagaaaatggaattgtaaggttatggagcacatgggacttaaagcctgtgagagaaattacatttcccaaatcaaataagcccatcatcagccttacattttcttgtgatggccaccatttgtacacagcaaacagtgatgggaccgtgattgcctggtgtcggaaggaccagcagcgcttgaaacagccaatgttctattccttccttagcagctatgcagccgggtgaatgcgaatgaacttcacgttctccaaagcactttaactccaaactagatttgttgacttcaccagttttaggaggttgaacctaaagaaatggatgactggacaaaccatccaaataatgataaagtctattcatctgcacaaaattctgaagagtcacatgatcctaagaggaaagttctgttctattttagtgataatctggaagattgtgtcaatatgcactagccaacaagttttaagcctcgcatggtacattaaaatgatattcttaaaattttttcccaccaaggtattccaaagaaaatattaaggtctcccctttttctatgattccaaaaggaccagtagaatttaaattggttggttgattgtttatataaaacacactaaaattatattttaaaagtttactgccatgaaatactcctcccaccacacacacatgctccaaaagaggaaagaaaaaaagataatttttaggacttgataattgctttctttgagaagcaaattattcagtaggtgcctctgtaccaaatattttatggaatatctaaatactaaaataaactatgaatgaatctcaaaattaggcagtttttgccagttgctttcttagctcaaaggagaaccagaatttttttgacagccacaaacaagaatacaggtatcttggatttcagacacattctgtttcttcataaaaattttacttaaaatctgtaacgctagatattgactatccttagttgagtcactgaggtttaaacacaatggtaagtcttaaagtctgctatttacagagcattgaatctgtaccaatttgcaatagaaagccttcagtatgcaagaagtttgcatgggtattaagaacacagcctaaataaggcatttgatctaatctgcaggaagaattttcttccccaaaacagaattataaaagcttactttaaacaggaggcagaataattcttttaggaaaccatttcattctgtttctactaacctataccatctgagaattctaggaagaataataaaatctcgtgtattccacagcaaacttacataccataaagacagaattcctaaacatcttggagccgtctgtctctcccatatgatggctgtctgtatatttttacttggggtgctgctttattggctttgaaaacactgtcagataagctcagtaatatgttaccatgggataaaaatatgtatccctgcctaagaataacttgtgcatttgttatggaaatttaattcatatggtgtttacagtactacttttgtaacttccagactttctaaaacattctgcttaaaaaccatataaaatataattccaaagtctctgctgtcaagatagattcgagagaaagcacgtggccatgtatgctttaaccttaaactgcatacacatgtagtgatacctaggctgcatttagatcaccgtgtgctcaggccaggtgtgaatcctgaggtccatggaggtgcagagatgagattactcctattcacgttgaagtgatttgctttgttaacaaaaaattgcagctattgtctagctttcatttttttactgagaactttaaattagtcccctattagaatagggttgctactcatctttttttaaaaaccgaatttcatcatttatctaaagagaaaatatgcagaataactggtcttgttaagagtgcaatattatatttttatgtaaaaataaaaattaatttggggggattatttattcagcatgaaacctaatatgtatatgtttgaaatacttcataatgtgcatgttgtagcaaacatttctgtaaattatcacaagctctgttacctttatatacactgcctcttcaatttggaaataaatttcataaaaata

SEQ ID NO: 16703 - DNA, 6650 bp, Homo sapiens
tgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgaagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggaagcctgatgttactttggattttatgcttccaagaaaaacaagtttgtcatctgatagcaataaaacattttgcatgattggccattgtttatcatcccaagaagagtttttgcagttggctggaaaatgggacctgggaaatttgcttctcttcaacggagctaaggttggttcacaagaggccttttatctgtatgcttgtggacccaaccatacatctgtaatgccatgtaagtatggcaagccagtcaatgactactccaaatatattaataaagaaattttgcgatgtgaacaaatcagagaactttttatgaccaagaaagatgtggatattggtctcttaattgaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaagacccttcttgaaggatgctgtggtgaagatattatttatatgaatgagaatggagagtttaagttggatgtagactctaatgctataatccaagatgttaagctgttagaggaactattgcttgactggaagatatggagtaaagcagagcaaggtgtttgggaaactttgctagcagctctagaagtcctcatcagagcagatcaccaccagcagatgtttaatattaagcagttattgaaagctcaagtggttcatcactttctactgacttgtcaggttttgcaggaatacaaagaggggcaactcacacccatgccccgagaggtttgtagatcatttgtgaaaattatagcagaagtccttggatctcctccagatttggaattattgacaattatcttcaatttccttttagcagttcaccctcctactaatacttacgtttgtcacaatcccacgaacttctacttttctttgcacatagatggcaagatctttcaggagaaagtgcggtcaatcatgtacctgaggcattccagcagtggaggaaggtcccttatgagccctggatttatggtaataagcccatctggttttactgcttcaccatatgaaggagagaattcctctaatattattccacaacagatggccgcccatatgctgcgttctagaagcctaccagcattccctacttcttcactactaacgcaatcacaaaaactgactggaagtttgggttgtagtatcgacaggttacaaaatattgcagatacttatgttgccacccaatcaaagaaacaaaattctttggggagttccgacacactgaaaaaaggcaaagaggacgcattcatcagtagctgtgagtctgcaaaaactgtttgtgaaatggaagctgtcctctcagcccaggtctctgtcagtgatgtcccaaagggagtgctgggatttcca

SEQ ID NO: 16704 - DNA, 2699 bp, Homo sapiens
gtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctccccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagccggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaacatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttatttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttttggggtgggccttgtccttctgtcagctaaaatgggagctcatgagagaaggacgtcagggaaacggggttgagggtggtctcggtgcagagagaagggtgtcagggaaacggggggtgagggtggtcttggtgccagacgtagggaatggtgttgggagtggcccgagtgcctggcacagttgtctggttcattcatgtaacatgataatttttaaatcattaaaaaaattacctttcatacaga

SEQ ID NO: 16705 - DNA, 1441 bp, Homo sapiens
accgccgcccgcgcccccgctccccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctga

SEQ ID NO: 16706 - DNA, 1867 bp, Homo sapiens
ccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagcttaaaatccaaagtgtcatatttactggtcctggagacaaacttgttcaaaagaacatcaacgtgcaatgttttaaggtctatcttaagaagccctggccaaattttgatcctaaccttgaagtatgccttgaacttattaacatggccattataagaataaaatatgtagttgtgtcttaatggaattaataaatgtcatttcactactggtgttctgtttcaatgtataaggactatagtgatttaaactcatcaatgtgcctttgcataaagttcattaaataaatattgatgtggtataaatgcccatcagatatgct

SEQ ID NO: 16707 - DNA, 4030 bp, Homo sapiens
ccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcattatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaa

SEQ ID NO: 16708 - DNA, 2089 bp, Homo sapiens
gagattggctgtaagcaagaaagagccccgcccctagtcttatgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagctgaagaatgttctgctgactctgacctcaactttcttattcctgttgcagtgggtgtggccttgggcttccttataattgttgtctttatctcttatatgattggaagaaggaaaagtcgtactggttatcagtctgtgtaatcagttaaatctagtgtttgtttgtttttttcaattagaagttacgtttccattggctaaaagccaggacatgctgtgcaatagattgtttaagatatgcagactaacttcagtgagttcctagctaacttgggcatgagtacacttatttaagacaaaatatattaggaccaatttttttctgttttttttcttcctttgttaaagtataattaaaagaaaaattgtggcttagaattttttaagtaaataatgattttaagcccctggatccaattatgaaagcatttttgctgatgtgtaattttatatgttacagttacttatattttactactttgatgttatttgcaaaatcaaaggtgttaaagaatttaacttgcttcaggaaataaattcaagaacatagtggattcattttcattggtggcagacacgaaatttggttcatgataagacttcctttccccacctcctgatcagcattatttaaatctgtatttttctgttagttaagaaagaaatggcttcatgatattgtatttaatagcaaaagtttggctgtcttcttcattactgttaatagctactatattttaacaaggagatttctttttttgttgttgttgttctagagtttggaatatactgattatc

SEQ ID NO: 16709 - DNA, 1433 bp, Homo sapiens
gtcttatgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagctgaagaatgttctgctgactctgacctcaactttcttattcctgttgcagtgggtgtggccttgggcttccttataattgttgtctttatctcttatatgattggaagaaggaaaagtcgtactggttatcagtctgtgtaatcagttaaatctagtgtttgtttgtttttttcaattagaagttacgtttccattggctaaaagccaggacatgctgtgcaatagattgtttaagatatgcagactaacttcagtgagttcctagctaacttgggcatgagtacacttatttaagacaaaatatattaggaccaatttttttctgttttttttcttcctttgttaaagtataattaaaagaaaaattgtggcttagaattttttaagtaaataatgattttaagcccctggatccaattatgaaagcatttttgctgatgtgtaattttatatgttacagttacttatattttactactttgatgttatttgcaaaatcaaaggtgttaaa

SEQ ID NO: 16710 - DNA, 1625 bp, Homo sapiens
aacactgggcggcggcggttggcccggggaggcaagcggtgacctagagaaggcctgaccgacggatggcggggaagaagggcccaggagagagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtag

SEQ ID NO: 16711 - DNA, 1530 bp, Homo sapiens
gttaaaagatgttaaatactggggccagctcaccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttacattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 16712 - DNA, 808 bp, Homo sapiens
tcttgagctaggaaaggattactcgagccttgttagaatcagacatggcttcaggggatgcaggacgctcccctgagctgcctgtcaccgactaagtggagcagtgtttcttccgcagactcaactgagaagtcagcctctgcggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcgtattatgagagcggctacaacaccacagcccagacggtcctggatgacggcagcatcgactacggcatcttccagatcaacagcttcgcgtggtgcagacgcggaaagctgaaggagaacaaccactgccacgtcgcctgctcagccttggtcactgatgacctcacagatgcgattatctgtgccaagaaaattgttaaagagacacaaggaatgaactattggcaaggctggaagaaacactgtgaggggagagacctgtccgactggaaaaaagactgtgaggtttcctaaactggaactggacccaggatgctttgcagcaacgccctagggtttgcagtgaatgtccaaatgcctgtgtcatcttgtcccgtttcctcccaatattccttctcaaacttggagagggaaaattaagctatacttttaagaaaataaatatttccatttaaatgtc

SEQ ID NO: 16713 - DNA, 904 bp, Homo sapiens
gtcatggagaactcttgggtgcagacaagtggatgattaatgaagtagcatctgaaaaacccaaggaaccaaatgtaggtggagcaacttccctgcaacacacgtcgaagctgctgcagtggctgttcttcccctccccttggaaaggcaccaaaagccagcctttggaagggctggtggactgtgcccttctttcccttcagagaaccagtgtccctgtgactccacccactcatctggccaccgttgccctgacctgccaggagcctggagaagatgaaggcatccgtggttctctccctccttggctacctggtggttccaagtggtgcttacatcttggggcgttgcacagtggctaagaaactccacgatggaggcctggattattttgagggctatagccttgagaactgggtgtgcctggcctacttcgagagcaagttcaaccccatggccatctacgagaacacacgtgagggctacactggctttggcctctttcagatgcgtggcagtgactggtgtggcgaccatggcaggaaccgctgccatatgtcatgttccgctttactgaatcctaatttagagaagacaattaaatgtgccaagaccattgtaaaaggaaaagaagggatgggagcatggcccacctggtcccggtactgccagtactccgataccctggcacggtggctggatggttgcaagctgtagccacctgcatggcccctgcagcactcaccagttgcatcttgtgaatgaaggtgcttttctgcttgctgcttcagtcaatccttttgatgatctcaccactttaagagttccagatggaaaaagacaaaagtttgcttcatccggggatgcaggatgcagaataaaccaaactagttactcaacttgg

SEQ ID NO: 16714 - DNA, 838 bp, Homo sapiens
aagtagcatctgaaaaacccaaggaaccaaatgtaggtggagcaacttccctgcaacacacgtcgaagctgctgcagtggctgttcttcccctccccttggaaaggcaccaaaagccagcctttggaagggctggtggactgagaaccagtgtccctgtgactccacccactcatctggccaccgttgccctgacctgccaggagcctggagaagatgaaggcatccgtggttctctccctccttggctacctggtggttccaagtggtgcttacatcttggggcgttgcacagtggctaagaaactccacgatggaggcctggattattttgagggctatagccttgagaactgggtgtgcctggcctacttcgagagcaagttcaaccccatggccatctacgagaacacacgtgagggctacactggctttggcctctttcagatgcgtggcagtgactggtgtggcgaccatggcaggaaccgctgccatatgtcatgttccgctttactgaatcctaatttagagaagacaattaaatgtgccaagaccattgtaaaaggaaaagaagggatgggagcatggcccacctggtcccggtactgccagtactccgataccctggcacggtggctggatggttgcaagctgtagccacctgcatggcccctgcagcactcaccagttgcatcttgtgaatgaaggtgcttttctgcttgctgcttcagtcaatccttttgatgatctcaccactttaagagttccagatggaaaaagacaaaagtttgcttcatccggggatgcaggatgcagaataaaccaaactagttactcaa

SEQ ID NO: 16715 - DNA, 891 bp, Homo sapiens
ggtgaggaagaagaggctcctactgtagacagccttgttctacagatcctcccagaaatctctgggccaggtggaacccagggtcagagagggatgggagagagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggaggacttggatgggtttgagggttactccctgagtgactggctgtgcctggcttttgtggaaagcaagttcaacatatcaaagataaatgaaaatgcagatggaagctttgactatggcctcttccagatcaacagccactactggtgcaacgattataagagttactcggaaaacctttgccacgtagactgtcaagatctgctgaatcccaaccttcttgcaggcatccactgcgcaaaaaggattgtgtccggagcacgggggatgaacaactgggtagaatggaggttgcactgttcaggccggccactcttctactggctgacaggatgccgcctgagatgaaacagggtgcgggtgcaccgtggagtcattccaagactcctgtcctcactcagggattcttcatttcttcttcctactgcctccacttcatgttattttcttcccttcccatttacaactaaaactgaccagagccccaggaataaatggttttcttggcttcctccttactcccatctggacccagtcccctggttcctgtctgttatttgtaaactgaggaccacaataaagaaatctttatatttatcg

SEQ ID NO: 16716 - DNA, 899 bp, Homo sapiens
ttaattttccatgataaataaaaatctataaaataataaacaagagaaaagagattggaaacagccaggttggagcagtgagtgagtaaggaaacctggctgccctctccagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggaggacttggatgggtttgagggttactccctgagtgactggctgtgcctggcttttgtggaaagcaagttcaacatatcaaagataaatgaaaatgcagatggaagctttgactatggcctcttccagatcaacagccactactggtgcaacgattataagagttactcggaaaacctttgccacgtagactgtcaagatctgctgaatcccaaccttcttgcaggcatccactgcgcaaaaaggattgtgtccggagcacgggggatgaacaactgggtagaatggaggttgcactgttcaggccggccactcttctactggctgacaggatgccgcctgagatgaaacagggtgcgggtgcaccgtggagtcattccaagactcctgtcctcactcagggattcttcatttcttcttcctactgcctccacttcatgttattttcttcccttcccatttacaactaaaactgaccagagccccaggaataaatggttttcttggcttcctccttactcccatctggacccagtcccctggttcctgtctgttatttgtaaactgaggaccacaataaagaaatctttatatttatcg

SEQ ID NO: 16717 - DNA, 1047 bp, Homo sapiens
tgttagttgggcagggctgaagtgtatgtggtgaggaagaagaggctcctactgtagacagccttgttctacagatcctcccagaaatctctgggccaggtggaacccagggtcagagagggatgggagagaggtttaattttccatgataaataaaaatctataaaataataaacaagagaaaagagattggaaacagccaggttggagcagtgagtgagtaaggaaacctggctgccctctccagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggaggacttggatgggtttgagggttactccctgagtgactggctgtgcctggcttttgtggaaagcaagttcaacatatcaaagataaatgaaaatgcagatggaagctttgactatggcctcttccagatcaacagccactactggtgcaacgattataagagttactcggaaaacctttgccacgtagactgtcaagatctgctgaatcccaaccttcttgcaggcatccactgcgcaaaaaggattgtgtccggagcacgggggatgaacaactgggtagaatggaggttgcactgttcaggccggccactcttctactggctgacaggatgccgcctgagatgaaacagggtgcgggtgcaccgtggagtcattccaagactcctgtcctcactcagggattcttcatttcttcttcctactgcctccacttcatgttattttcttcccttcccatttacaactaaaactgaccagagccccaggaataaatggttttcttggcttcctccttactcccatctggacccagtcccctggttcctgtctgttatttgtaaactgaggaccacaataaagaaatctttatatttatcgaaatattaaagca

SEQ ID NO: 16718 - DNA, 5102 bp, Homo sapiens
aaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtctcccagacctggtggccgacccctactacatccaggcgtccacgtacgtgcagaagatgtccatgtacaacctgagatgcgcggcggaggaaaactgtctggccagtacagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtaaaacctggaaactatatcctaaaggtcagtgtaaaccccagctacctggttcctgaatctgactataccaacaatgttgtgcgctgtgacattcgctacacaggacatcatgcgtatgcctcaggctgcacaatttcaccgtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctgaaatgtctgccttttaaatataacacctactatttggttaattttgacgatttttttttttcaattaggaagctaaaaatactactttattccttatatgaacattcatccccctcctggcacctctaaacacacccaaataactcacaagtactgatttaacactctgtattactgaacttctttgaactattttgaactttgaatctcttctctgaataactgccgaaactcaaagataataattagttgatgaaggttatcaattaataaaataacacagaccagtcttaccaaactctaaatacattttaaaaaataggaactggcaatgataaaaagaatgttgagtactgacaggagattggcttttacactaaaaaagacagaaaatggactaaataggaacataatttcagagtttatgagtcagtttacaatatgccatattagcgatctcatgatgattcagaccacagtctgggttaaagatgtcttgacctctgaggctagcataacatatatgagaatacaacttgcctatttccagaaaatctgtatatttttatagaataactttatttacaatttctatcatccaattactcactaggcattatttgtagtactttttttctctttgaaatctcataggatagtcacacttataaacattcccaatattcggattctagaagaaatgcaattcattaaaattttcctggcactgagagttaatctttagcagattgcatgaaaatactgaattcctggtaaggagatattttgttttaaaaataatgtgttttgatacgaatcagtgtattaactgataactaaaaagtactcttttttctatatatacatatttttttgaactcatattcacaatcaacatattcaatcagtgagttaagtctcattcctagctaccaaaattcctgggccacttttaaacactaaacatttcatttatcctctaagctaaaatggtgctgagttatttaaatctgaatgtaaaatgcattaaatcttagcttgtggtatataaacatttaattaatataaaactgcttgctataaactaagtaacatgtcatttggtgttaggtttttagtgaagttttagcttctcccaaatttttcaggaatgttatttgtaagacgtgtaacttttttgaagaactcttattttaaatgctcagacattggctttatgttcctctttgcattctcatattcttttattatacatctatactatgattgcaagattatataaaaatgccttgaataaatgatttcaagtgtc

SEQ ID NO: 16719 - DNA, 565 bp, Homo sapiens
agattaagccagtgtgtctcaggatacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactc

SEQ ID NO: 16720 - DNA, 1724 bp, Homo sapiens
agacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgccgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtctcccagacctggtggccgacccctactacatccaggcgtccacgtacgtgcagaagatgtccatgtacaacctgagatgcgcggcggaggaaaactgtctggccagtacagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtaaaacctggaaactatatcctaaaggtcagtgtaaaccccagctacctggttcctgaatctgactataccaacaatgttgtgcgctgtgacattcgctacacaggacatcatgcgtatgcctcaggctgcacaatttcaccgtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgc

SEQ ID NO: 16721 - DNA, 3549 bp, Homo sapiens
acaacaaaagaggccggaggccgggcctgctgcggcggccgccttcggggaagggggtgggtccggggaggggtttgccatcctcctctagttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcaagattccggaaagcgtacaagccagagcaacccctggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcatgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgcgggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacagcccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaaga

SEQ ID NO: 16722 - DNA, 588 bp, Homo sapiens
tatttgtgttgaggggaccagctgttagtctttctgctgctctttctaagaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacgga

SEQ ID NO: 16723 - DNA, 763 bp, Homo sapiens
cggaggccgggcctgctgcggcggccgccttcggggaagggggtgggtccggggaggggtttgccatcctcctctagttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaagttctgaactcccggtctccccagtccctggaggctgcctgcagctttgcttagcttctcagcctgttgatcactgccgtggaattggcgagtatcttccgggggaaagcagagacaaaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgt

SEQ ID NO: 16724 - DNA, 746 bp, Homo sapiens
cagccatcggagaccagagccgccccctctgctcgagaaaggggctcagcggcggcggaagcggagggggaccaccgtggagagcgcggtcccagcccggccactgcggatccctgaaaccaaatggagtctcgctctgtcacccaggctggagtacagtggcacgatcttggctgactgcaagctttgcctcccgggttcaagcgattctcctgcctcaagcctcctgagtaactgggactacagaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacc

SEQ ID NO: 16725 - DNA, 3502 bp, Homo sapiens
taggactgatctccaggaccagcactcttctcccagcccttagggtcctgctcggccaaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccaggatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctcattttttactataatatgttgctaggtataattttattttatataaaaagtgtttctgtgattcttcagagcccaggagtcagtgctggtggttggagggacctgcccccactggttcatttaaccctctgtctcggtgccctcagaacctcagccagaaaggcaaggaggaaatcagagcaggagcctcatactcttggtgatctattcattctgtgacctcaggggtcacatataaggtcagtgtttctcgtccccgccggatctgcactgccaactgggattgggttcgaacagcttcataaacatcttcagcattttgtaccatctgctccccaatggccaaaatcacatcaccaggccgcagaccagccctatagagaaaaatggacagagagaaaggaaggagtacaaagcctagttcaaggacacatgcacaccttgcccatccccatatcacactgcagcctctccctcaccggtgtgcaggggagcccaggatgactttatggatgagtacaccatgctgaacatcgggaaagcttggttctcgaagctgtagttcagcaaggatgctgaaagtacacagatcaccctattagccaaacccaggcattctccccatcctgagttccacctcaagtctctcatcaacacattgataaatatatggacaggacatgggctaggtactacaaaatacaatggcaactcactttctgtcttctagcaataaagtgcaacatgtacataaaa

SEQ ID NO: 16726 - DNA, 2398 bp, Homo sapiens
tttttttttttttttggaagtcctaggactgatctccaggaccagcactcttctcccagcccttagggtcctgctcggccaaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccaggatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctcattttttactataatatgttgctaggtataattttattttatataaaaagtgtttctgtgattc

SEQ ID NO: 16727 - DNA, 2897 bp, Homo sapiens
atactgagtgcttagttctttgcctatcactttctatccgttgtctctctcctctgtgtctttctggttttctctctctcattcccacagtctcccttcctctcacatcctgtctgtctgggtcttcctctctctctacgtgtctcttgctcagtctctatctctttttattgacccttctctgactctcgatctctcatagttgtctcttatctctgggtctctcaggctgtgcctctatgacctgtgcctcagcccttatttaatgtgtttctctccctgtctcttggtccctggggctctttctctcctgttgtctctcgctgtctctgtcttactcagtgtctgtttttctttcgtgacttctccctctctttctgactctgggccccactcaatctgtttctctcacgcacactttgtctctggggcacccaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccagggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttag

SEQ ID NO: 16728 - DNA, 1001 bp, Homo sapiens
cccgggcttctgaggcgtctaccttcccaggtagggctgtacaaggagttctccagcatctccagggcagaaagcttaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcaggggg

SEQ ID NO: 16729 - DNA, 3653 bp, Homo sapiens
ggctggggggccgcgggcgggaggcggataaaaaggccccagggcgcccggggagggagcccgttagcgctgctccgccgcggcgcccgcccagccccggactgtccgcgctccatctggtatcttggcctcagctgtccttgaagtcaccatggcgtggtccccaccagccaccctctttctgttcctgctgctgctaggccagccccctcccagcaggccacagtcactgggcaccactaagctccggctggtgggcccagagagcaagccagaggagggccgcctggaggtgctgcaccagggccagtggggcaccgtgtgtgatgacaactttgctatccaggaggccacagtggcttgccgccagctgggcttcgaagctgccttgacctgggcccacagtgccaagtacggccaaggggagggacccatctggctggacaatgtgcgctgtgtgggcacagagagctccttggaccagtgcgggtctaatggctggggagtcagtgactgcagtcactcagaagacgtaggggtgatatgccacccccggcgccatcgtggctacctttctgaaactgtctccaatgcccttgggccccagggccggcggctggaggaggtgcggctcaagcccatccttgccagtgccaagcagcatagcccagtgaccgagggagccgtggaggtgaagtatgagggccactggcggcaggtgtgtgaccagggctggaccatgaacaacagcagggtggtgtgcgggatgctgggcttccccagcgaggtgcctgtcgacagccactactacaggaaagtctgggatctgaagatgagggaccctaagtctaggctgaagagcctgacgaataagaactccttctggatccaccaggtcacctgcctggggacagagccccacatggccaactgccaggtgcaggtggctccagcccggggcaagctgcggccagcctgcccaggtggcatgcacgctgtggtcagctgtgtggcagggcctcacttccgcccaccgaagacaaagccacaacgcaaagggtcctgggcagaggagccgagggtgcgcctgcgctccggggcccaggtgggcgagggccgggtggaagtgctcatgaaccgccagtggggcacggtctgtgaccacaggtggaacctcatctctgccagtgtcgtgtgtcgtcagctgggctttggctctgctcgggaggccctctttggggcccggctgggccaagggctagggcccatccacctgagtgaggtgcgctgcaggggatatgagcggaccctcagcgactgccctgccctggaagggtcccagaatggttgccaacatgagaatgatgctgctgtcaggtgcaatgtccctaacatgggctttcagaatcaggtgcgcttggctggtgggcgtatccctgaggaggggctattggaggtgcaggtggaggtgaacggggtcccacgctgggggagcgtgtgcagtgaaaactgggggctcaccgaagccatggtggcctgccgacagctcggcctgggttttgccatccatgcctacaaggaaacctggttctggtcggggacgccaagggcccaggaggtggtgatgagtggggtgcgctgctcaggcacagagctggccctgcagcagtgccagaggcacgggccggtgcactgctcccacggtggcgggcgcttcctggctggagtctcctgcatggacagtgcaccagacctggtgatgaacgcccagctagtgcaggagacggcctacttggaggaccgcccgctcagccagctgtattgtgcccacgaggagaactgcctctccaagtctgcggatcacatggactggccctacggataccgccgcctattgcgcttctccacacagatctacaatctgggccggactgactttcgtccaaagactggacgcgatagctgggtttggcaccagtgccacaggcattaccacagcattgaggtcttcacccactacgacctcctcactctcaatggctccaaggtggctgaggggcacaaggccagcttctgtctggaggacacaaactgccccacaggactgcagcggcgctacgcatgtgccaactttggagaacagggagtgactgtaggctgctgggacacctaccggcatgacattgattgccagtgggtggatatcacagatgtgggccccgggaattatatcttccaggtgattgtgaacccccactatgaagtggcagagtcagatttctccaacaatatgctgcagtgccgctgcaagtatgatgggcaccgggtctggctgcacaactgccacacagggaattcatacccagccaatgcagaactctccctggagcaggaacagcgtctcaggaacaacctcatctgaagctgtcactgcacactcctagctgctgccgatacaccagatacctcagcttattggagccatgcccttcacagagtcccaactcagaggaaaagggccagtgccaaggggcaccaagaacctgctcaggaagccttttgatggcaagatcaccaatccagatggtattgctccctcaggatggctctgggcctgcccctaagggcctgtggcctatggaatatgtcctccaggctttgctcagctgagctcctcttctgtaaggaaacccagtcatccctgaatcttgccacagagatccgggattcaggagctctcagtttcttagggatggactatggcccagtcccccatctaagtggtgctttgcaaatgtcttggaggagtataggacagaggaccaaaatacacagcaggtagtgttagctctctgctaggagctcaaagcaacacaacttgtatcaaaatcacaactggcagagaagctggtggatccaatcctttcttcatctgttgttatttagaactcacctctcacactctgttctttagtgtccttacctttatcttaccacacacatgggtgtttctattatccttggaagcacagacctcgggcatccccttattgcctgatgggccaacaccaacagttacggagtgcttgagaaggggcaagtttcacagaaatggccagatagggccttcctacagagcagcaagagtaggccaagcagaaagactgctgaggtaacacggaccccagcccctgtcagggcctctgccaaggaaataatatggaccatttacctggcaggcagtctgctctctctcaggatcaccacgcatctcaggattggtctaaacttcaagtctcaaccaagtgtctgaagtgaactttgcattgaataaatttttgccatggaaagaacatcaaacaagccactcatctctacagagataagaaaacaagtttggcagagcaagagacagaagaccgtggagaaatcagaagggggaacagtcagtttagttaaggatggaacctgggaaaggccaccattcctgcttgatggggctctgatttgctcttgctcaagtggaataaaaccccatggtcttcttgacatgattcttgatcttttctccactgagacacacttaagtgatgatccttacaggactgacaccctaatgccaataaaagttgctcattatggactgctacaaa

SEQ ID NO: 16730 - DNA, 2005 bp, Homo sapiens
gtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 16731 - DNA, 2171 bp, Homo sapiens
acttttgggtcgggccctccgggaagatggcggccgtgcaggcggccgaggtgaaagtggatggcagcgagccgaaactgagcaagaagtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 16732 - DNA, 3182 bp, Homo sapiens
agtagtgcttggtttccaacagctgctgctggctcttcctcttgcggccttttcctgaaacggattcttctttcggggaacagaaagcgccagccatgcagccttggcacggaaaggccatgcagagagcttccgaggccggagccactgcccccaaggcttccgcacggaatgccaggggcgccccgatggatcccaccgagtctccggctgcccccgaggccgccctgcctaaggcgggaaagttcggccccgccaggaagtcgggatcccggcagaaaaagagcgccccggacacccaggagaggccgcccgtccgcgcaactggggcccgcgccaaaaaggcccctcagcgcgcccaggacacgcagccgtctgacgccaccagcgcccctggggcagaggggctggagcctcctgcggctcgggagccggctctttccagggctggttcttgccgccagaggggcgcgcgctgctccacgaagccaagacctccgcccgggccctgggacgtgcccagccccggcctgccggtctcggcccccattctcgtacggagggatgcggcgcctggggcctcgaagctccgggcggttttggagaagttgaagctcagccgcgatgatatctccacggcggcggggatggtgaaaggggttgtggaccacctgctgctcagactgaagtgcgactccgcgttcagaggcgtcgggctgctgaacaccgggagctactatgagcacgtgaagatttctgcacctaatgaatttgatgtcatgtttaaactggaagtccccagaattcaactagaagaatattccaacactcgtgcatattactttgtgaaatttaaaagaaatccgaaagaaaatcctctgagtcagtttttagaaggtgaaatattatcagcttctaagatgctgtcaaagtttaggaaaatcattaaggaagaaattaacgacattaaagatacagatgtcatcatgaagaggaaaagaggagggagccctgctgtaacacttcttattagtgaaaaaatatctgtggatataaccctggctttggaatcaaaaagtagctggcctgctagcacccaagaaggcctgcgcattcaaaactggctttcagcaaaagttaggaagcaactacgactaaagccattttaccttgtacccaagcatgcaaaggaaggaaatggtttccaagaagaaacatggcggctatccttctctcacatcgaaaaggaaattttgaacaatcatggaaaatctaaaacgtgctgtgaaaacaaagaagagaaatgttgcaggaaagattgtttaaaactaatgaaataccttttagaacagctgaaagaaaggtttaaagacaaaaaacatctggataaattctcttcttatcatgtgaaaactgccttctttcacgtatgtacccagaaccctcaagacagtcagtgggaccgcaaagacctgggcctctgctttgataactgcgtgacatactttcttcagtgcctcaggacagaaaaacttgagaattattttattcctgaattcaatctattctctagcaacttaattgacaaaagaagtaaggaatttctgacaaagcaaattgaatatgaaagaaacaatgagtttccagtttttgatgaattttgagattgtatttttagaaagatctaagaactagagtcaccctaaatcctggagaatacaagaaaaatttgaaaaggggccagacgctgtggctcacacctgtaatcccagctctttggaggccgaggcaggcggatcacttgaggtcaggagtttgagaccagcctgaccaacatggtgaaactccatctctactaaaaatataaaaattagccgggcatggtgatgcatgcctgtaatcccagctactcgggaggcttagacatgagaatcacttgaacccaggaggtggaggttgcagtgagtcaagatggcaccactgcactccatcctgggtgacagagcaagacttcctctcaaaaaataaataaataaataagaaaaataaattaggaaattattaaaataattttttagaaaagcaacaaaataacaaaaattagtgactgtaataattggaatgtttgaaatttgtcacagcaataattgactaaaatgaatgtaaataattattcagttttcagtttgttgtaataaactctaatcagtataaaggattgactatcctaggaaaaagattagtcaaggaataagaagcaaaagtagtatttgaaatctaaaaacattaccatgtttgctttatcatgcaggcaaataaataaataaatgacatttttaggttggaataaaaaaagataaagtacatattgccttaattaaattcatcaagttcttactgaaaaacagctctccgccgtgcctggccaggaaatacataattttttttttttttttttagatggagtctcgctctgtcgcccaggctggagtccagtggcatgatcttggctcactgcaagctctgcttcctgggttcatgccattctcctgcctcagccttccgagtagctgggactacaggtgcccgccaccacatccggctaattttttgtatttttagtaaagatggggtttcaccatgttagccaggatggtctcgatctccttaccttgtgatccgcccgccttggcctcccaaagtgctgggattacaggtgtgagccaccacgcctggctgaaatacataatcttaaaagaaaacataagatactttattttaatatacgtgactaaatgtaaaacctaacttattttctgttatctatttatttttactttcagtaacactttttttattttaggtagcattcagcctagaggcaactgctgtttgttaaatatttcctgttcatatattttgcacattttcttatgggttagttttcttctcattgttttgggaagttcttaatatatttggggtatttatctttcattcgttgtctgtgtaacaaataacttctgccatatgggttgtctgcacattttttggtgtcttttagtaaacaaggtttttttgttttgtattgttttgtttattgtaaagatttttaaattttaatggagttgatttcttttctcattcaagcttttgagaataaattggagttgaatttttta

SEQ ID NO: 16733 - DNA, 1917 bp, Homo sapiens
aacagctgctgctggctcttcctcttgcggccttttcctgaaacggattcttctttcggggaacagaaagcgccagccatgcagccttggcacggaaaggccatgcagagagcttccgaggccggagccactgcccccaaggcttccgcacggaatgccaggggcgccccgatggatcccaccgagtctccggctgcccccgaggccgccctgcctaaggcgggaaagttcggccccgccaggaagtcgggatcccggcagaaaaagagcgccccggacacccaggagaggccgcccgtccgcgcaactggggcccgcgccaaaaaggcccctcagcgcgcccaggacacgcagccgtctgacgccaccagcgcccctggggcagaggggctggagcctcctgcggctcgggagccggctctttccagggctggttcttgccgccagaggggcgcgcgctgctccacgaagccaagacctccgcccgggccctgggacgtgcccagccccggcctgccggtctcggcccccattctcgtacggagggatgcggcgcctggggcctcgaagctccgggcggttttggagaagttgaagctcagccgcgatgatatctccacggcggcggggatggtgaaaggggttgtggaccacctgctgctcagactgaagtgcgactccgcgttcagaggcgtcgggctgctgaacaccgggagctactatgagcacgtgaagatttctgcacctaatgaatttgatgtcatgtttaaactggaagtccccagaattcaactagaagaatattccaacactcgtgcatattactttgtgaaatttaaaagaaatccgaaagaaaatcctctgagtcagtttttagaaggtgaaatattatcagcttctaagatgctgtcaaagtttaggaaaatcattaaggaagaaattaacgacattaaagatacagatgtcatcatgaagaggaaaagaggagggagccctgctgtaacacttcttattagtgaaaaaatatctgtggatataaccctggctttggaatcaaaaagtagctggcctgctagcacccaagaaggcctgcgcattcaaaactggctttcagcaaaagttaggaagcaactacgactaaagccattttaccttgtacccaagcatgcaaaggaaggaaatggtttccaagaagaaacatggcggctatccttctctcacatcgaaaaggaaattttgaacaatcatggaaaatctaaaacgtgctgtgaaaacaaagaagagaaatgttgcaggaaagattgtttaaaactaatgaaataccttttagaacagctgaaagaaaggtttaaagacaaaaaacatctggataaattctcttcttatcatgtgaaaactgccttctttcacagactctactgatatatttccaagtattaggtcacttgataagtgatccgcactgaagcaaaagataaactcagcattcttaggtgcttattctaatgccaccagttttacttctgttagcaaaaatctaaagtaacataacagacttatcacccccatttggaattagtatacaaatagaaatgatcctaatcaatttaattaattataatggacacacaagaaaaaatacctacacagcttttcgagaaacgaagacaatgactttgtctgtggatgacatactctgtagaaaagtttgcatgtgactccatttctcttcctcggtggttacaattatattttgcttcactgaacttacagcctaaaggattcaaagaacatagttcatcaaggtcatcatgattgagggtgagaccgcatacatcagctcaaaatgcatcttctctctcattggttaatgtttttaataaactgctaagcaaaatggcagacgtcctaaaaaaa

SEQ ID NO: 16734 - DNA, 2907 bp, Homo sapiens
gctcttagacaaaccaacagcagcttcttctgacatatacacacgcacactcaccccggacacacactcagcacacttttcctccatttgattaacagtgctgcacacacaatgattacgggaaagcgcaaataaatacggaaaggggtgcttattttgactactggaagagctttgctgggtctcagcgcaacttttgttttttattcctgagaaggtgatctctccatgcggttctctcacacaaggattctttaaaagaggaagagagacaagcagaggggggaggacagtctttcactttaagaacggctgggctcaaagataaaaggaagggaaaagcagcagcagcagcagcagcagcagcagcagcagcagcagcagcagcagcagcagcagggaaaccaacgctgcagcacttccgaaaggcatttttgatccatttctgagtgttgcggcccgtttctccaccgaagttggctccagctctagcagccgcattggatcccacagcttactgcgagactccggtgtacaatccggatctctgccccaacatgattgcggcccaggccaagctggtctaccatctgaataaatactacaacgaaaaatgccaagccaggaaagctgccattgccaaaactatccgggaagtctgcaaagtagtttccgacgtactgaaggaagtggaagtgcaggagccgcggttcatcagctctctcaacgagatggacaatcgctacgagggcctcgaggtcatctcccccaccgaatttgaagtggtgctttatctcaaccaaatgggggtgttcaacttcgtggacgatggctcactgcccggctgcgcggtgctgaagttgagcgacgggcgcaagaggagcatgtccctctgggtggaattcattaccgcctccggctacctctcggcgcgcaaaatccggtccaggtttcagacgctggtggctcaagcggtagacaaatgtagctaccgggatgtggtaaagatggtggcagacaccagcgaagtgaaactgagaatccgagataggtacgtggtgcagatcacgccggcctttaaatgcaccgggatctggccgaggagtgctgcccactggccacttccccacatcccctggccgggacccaaccgggtggcggaggtcaaggcggaaggtttcaatctcttgtccaaggagtgccactccttggccggcaagcagagctcggcggagagcgacgcctgggtgctgcagttcgcggaggcagagaacagactgcagatggggggctgcagaaagaagtgcctctccatcctcaaaaccttaagggatcgtcaccttgaactgccgggccagcccttgaacaattaccatatgaagactctggtttcctacgagtgtgaaaagcatccccgagagtcggactgggacgagtcttgcctgggtgatcggctgaacgggattttgctgcaacttatctcctgcctgcagtgccggcggtgtccccactactttctaccgaacttagatctgtttcaaggcaaacctcactcagctctggaaaacgctgccaaacaaacgtggcgactggcaagagagatcctgaccaacccgaaaagtttggaaaaactttagaggatgatttaatcaagagccgaaattattacccttctcaaagtccttattaagtgtaaacttctgttcaattcctaatattccactccgcagtgcaaacaatctcttcctttaaaaaggaataataatacaatatttaaacatcatctcacccacccccacaaggggagaaaaagtaggggaagcggatggagaaaaacccaaagccactagtattagaagacttctttccacacgatttcctatctcccttgaaaagtacaccgtaacactccgtaaacagcccagctgtaacgccagaccgagacgaacactctgcctaactatcaaaggattatagcaatcctggtgatttaggtgcatctgtctgtgagtaaacacgatttggatatgccatctgaaagaaactgtaatgtatattttgatttgtaacaaatattgtgatctcacattgtctttgaaagtgtggatgttggtgttttgtgatttggtgaacagaacttaaattgccattctggatacttccagacattttccactaacaaagatatcatttaaaggtagatttcttcctggtacttttatctgtctttgaaagtgtctgaactttaaaaagtttacattttgtttcaaatattgcttgttctatttctaacattccataaatatacttgaaatgttatttaaatatattcaaagaaatttgaattcagcttatataataacgcttgaatatctgaattatatatttgaaaaatgcacttgaaatacactggataattacttttgtgatttagattttaatttgttgctggtttttatttaattagatggtaataaatgaagtaaaataaaagttgttgtgtctcactttaaattgtttcctatcacaagatgtaatgatgcattttgaaaatcaaacccacttgaatatcttaaatattttgagaaatatgctaatgaaatccttaaaaataaaacattggagaaaagctctttctgtataggtccataagataacaatctactctcagtctctaacttacttgtaagacaattcctttctacaacagaaacaatttaaatctacctttgaaagcttgctcttcttgtagcatttttgataatataagaaaaaaagtctatcatgacagtagagatgactgagttaaaaatctgactaattcagaggaaatgaacttaacaaagtcataatgaaacttcgaaaattatgtatgaaaactaataaaacgatcctttctgaccaata

SEQ ID NO: 16735 - DNA, 4994 bp, Homo sapiens
gcgtgcgccctggggcccaagttggggcgcgccgtggctagaacacggagagcggcgggcagtgcagccaatgggaggcggcgctgcctagcggctggtaggcggtgcctgcgcgggtgttaggttagcgcgaggcgtgacctagttgacaggctctgaggtgctgctgtggcggcgtccgcggggctgaggcgggtgggagccggagccgagcgcgggctgagggaggagggcggcgactggagagcggcgagcggcgagcagcgcaggacgcagagcctctttcactttttccctgctgagtgccccctcccacccctcccactccacacacaccctgtttgcccgtgagcctggggaacttgcagcttaaagccagccacccccacggcaacatgtaccccagcaacaagaagaaaaaggtgtggagagaggagaaagaacgtttattgaagatgaccttagaagagagacgcaaagaatacctaagagactatattcccctgaacagcattctatcatggaaggaggagatgaagggcaagggccaaaatgatgaagaaaatactcaggaaacatcccaggtgaagaaaagtttgactgaaaaagtttctctctatagaggtgacatcacattgctagaggtagatgctatagtcaatgccgcaaatgccagtcttcttggaggaggaggtgtggatggctgtattcatagagcagccggcccctgtttgctagctgaatgtcgtaacctgaatggctgtgatactggacatgcaaaaatcacatgtggctatgaccttcctgcaaaatatgtcatccatactgtagggccaatagccaggggccatattaatggttcccacaaggaagaccttgcaaattgctataaatcatctctgaagctcgtgaaagaaaataacatccgatcagttgcatttccctgcatctcaacaggcatttatggctttcccaacgagcctgctgcagtcattgccctcaacaccattaaggaatggcttgccaagaatcaccatgaggtggatcggatcattttctgtgtcttcttagaagttgacttcaaaatctacaaaaagaaaatgaatgagtttttctccgtagacgataataatgaagaagaagaggatgttgaaatgaaagaagattcagatgagaacggtccagaggagaagcaaagtgtggaagaaatggaagagcagagccaagatgcagatggtgtcaacactgtcactgtgcccggccctgcttcagaagaggcagttgaagactgtaaagatgaagattttgcaaaggatgaaaatattacaaaaggcggtgaagtgacagatcattctgtgcgtgaccaagatcatcccgatggacaagagaatgattcaacgaagaatgaaataaaaattgaaacagaatcgcagagctcatatatggaaacagaagaactttcatcaaaccaagaagatgccgtgattgtggagcaaccagaagtgattccattaacagaggaccaagaagaaaaagaaggtgaaaaagctccaggcgaggacacacctaggatgcctgggaaaagtgaaggctccagtgacctagaaaatactccaggtcctgatgcaggggcacaagatgaagcgaaggaacaaagaaatggaactaaatgacaatcctcagcatcgcaaggcctctcctggctctgggggagctcgggaagatagcagcacacgctgtggaggagggtgggggtggggggaaggcaagtcccatggaaggacggggaatcctttactctaatttctccagctgcattttgttccgtttatctgcagaaaaagaaagaaaaaaaagaaaaaaaaagtttcctttaatttggtggagggacccatgttgacgcatctttcaggcattatccttgtaatttctgtcttttctcttacaactttgccccagggtcacagtggcttgattgaacactcacatgtgtatcctggcccctgtctgctttcttggttatttcacaaagctggtcacacagtggtttattcaaaggaaggggaggaagacagtggtttgataagctgcaggataaattttaggaatcaatgagcccagcagcagtataatccccagacagaggaggcaggatagaaaatgggcaaaagcctcggaaaccacttggaaaaggtctggacaatgaggtgaaaatattttcttcagggttcccaaggcacaatttgttccaagtggctaatgagaaatatggaagctgaattttttccagagcagagtgcagaggcataacagaagggtgggccctggcagccatctgggtctcttccttcctaaccatggtggcaggtgcatccttctttgacactgactttcagcagagcttacttggttcatgaggtcttcacatggagactaccagcaagaggtgactctctgctgcataactgtaaaggatggccctttgctaggtgttacagttaaaagctaagaaaaggggcagtgcatttaggacccaaacatatgcctatgaatatcaaaagctcctcctgaaattgctgtgagttttccataaaagaatatcctgtcttcacccaaggcttgacagcccacagagtggtctcatttgaaattacaggaaattagagcttttgcttgcagttctgccttcctggcctgtgtttaaatgctgtcacttgtttatgccaagttcaaggctgattcaatggttggtcccctcacccagaaaaccctgaaggggaggatacagctctgaaggggggcagcagtactaaaaacccaagatgccagtggtatagtgggcacaagggatggcgaccatgaggatgccaggcatcatcaccaatatctatcctagagccagtataaggccagatgcctacttcccacagcctccccgggttccaaagtcatgtcattgttttcagtggaaacatatcgtttgttgcatatcttcttaaatccatcttccttgtaagggctttagaactaaaacttacttatattgtttttccttaacagagggagaaaaatagtggattattatttctaaaataaaaggatgttctgctttctaaatatcccatcaaaatcttcagttttgcacttttttgatggaaaattcatcttatcttcctatgactttggttttagcctttctgaatttgttaccccttctggatggcttatttgatatactggaatagttaacaagctatacttcagcatatgcactatattctaacaaattttttttaataaaatcaagacatcagcaagaatgacatttacgtgacctcataatgtgggattatggccttctgttgctattccagtttgatatggaagcatctatatcctctattgccgttagatgttgttgcttttcagaaaagtaacgaaaaggctcattttaaagaatccaagaaacgatgtcatccaaatattgacagtttctacatttcatgccatctttataactcaattgaaagttgccgtcattcttgtgaagtatttgacaagtgcaatctgctagaagctcgtttttcttgtgactcccaaatgttagtgctacttagcctcagtaatgagttacagttgaaaaaaacatgagggaaacagagggacagagattttctaatgaacaatgatggaagagacctaatgtccttgctagaaacagccaggatggaaattatccagccctggcattctccttatcatcaatgacagtcattttattcatttatttcaaatgtgggtgggctagaagtggaaggagggaattctctctgcctaaaaattctagaagaatgaaagtaatctttgtatccaggaaactaagagaatgaggaataaatatcttcagcccgactcctgaatttgtttattcttccatctataattagattgtgttttcatttttgctttgtcatgctttttggttgttatttggctatacagttttatgctttaaaacaaatgataaagttaatttccaattcaatagtgaaatattaacaatctaactatagccagatcaaagacacctgaacacagaaaacctttatttgctggtgctgccattgcacaggctgtacaatgaaatagatttgaaaagctgattgattttcccgcacataaattctggatgtcaatttccaaccaaactccaatacagctatgtggcatgaagagttacaggagggagggaggaaaatagccctatgttagtcatgtttgcatacagaggatcaaagtaggccttcaccataatagttctaattaaaatggtcctcgctgtaggagagacaaaggggcttttcctctagctggtaactattcagatgatggacaagtcttctttcataaaagattacaaagaaggcatccgaatcactgtctgtgatactgggtcacatattaatcactgcagctaattgtaaatctttctatgaaacactgaaaagcctctttgtgaattaatacagttctgcttgatgcacttgatttgaaaagacatttctctgtatgtggcgcatgtcggctttgctttgaaaaataacaaagttagcagaatatgttcaatatattttcttggggaatagggtttttattacatgattcattaaggatttgccttaccctgacatttgtgatataaaggaaaatcagaaaaaaagtaattttcttgatcaagatatgtttttacttaatgcaaataaatgtagtctgttgcttgcaaggaaaaaaaaatggcttctgatatctggtataaactgctaaataggataatacgtgcctcttttgttaaaccggcatttaaatgctggactgcttctaaatctgtttgtttcttttcatctgtgccatacactaaaaaacaactgttgccttcatactatatttgttagagcagaatacaaataaaatttgtttgagaggataatgtgaaa

SEQ ID NO: 16736 - DNA, 1347 bp, Homo sapiens
atgtaccccagcaacaagaagaaaaaggtgtggagagaggagaaagaacgtttattgaagatgaccttagaagagagacgcaaagaatacctaagagactatattcccctgaacagcattctatcatggaaggaggagatgaagggcaagggccaaaatgatgaagaaaatactcaggaaacatcccaggtgaagaaaagtttgactgaaaaagtttctctctatagaggtgacatcacattgctagaggtagatgctatagtcaatgccgcaaatgccagtcttcttggaggaggaggtgtggatggctgtattcatagagcagccggcccctgtttgctagctgaatgtcgtaacctgaatggctgtgatactggacatgcaaaaatcacatgtggctatgaccttcctgcaaaatatgtcatccatactgtagggccaatagccaggggccatattaatggttcccacaaggaagaccttgcaaattgctataaatcatctctgaagctcgtgaaagaaaataacatccgatcagttgcatttccctgcatctcaacaggcatttatggctttcccaacgagcctgctgcagtcattgccctcaacaccattaaggaatggcttgccaagaatcaccatgaggtggatcggatcattttctgtgtcttcttagaagttgacttcaaaatctacaaaaagaaaatgaatgagtttttctccgtagacgataataatgaagaagaagaggatgttgaaatgaaagaagattcagatgagaacggtccagaggagaagcaaagtgtggaagaaatggaagagcagagccaagatgcagatggtgtcaacactgtcactgtgcccggccctgcttcagaagaggcagttgaagactgtaaagatgaagattttgcaaaggatgaaaatattacaaaaggcggtgaagtgacagatcattctgtgcgtgaccaagatcatcccgatggacaagagaatgattcaacgaagaatgaaataaaaattgaaacagaatcgcagagctcatatatggaaacagaagaactttcatcaaaccaagaagatgccgtgattgtggagcaaccagaagtgattccattaacagaggaccaagaagaaaaagaaggtgaaaaagctccaggcgaggacacacctaggatgcctgggaaaagtgaaggctccagtgacctagaaaatactccaggtcctgatgttgaaatgaatagtcaggttgacaaggtaaatgacccaacagagagtcaacaagaagatcaactaatagcaggggcacaagatgaagcgaaggaacaaagaaatggaactaaatga

SEQ ID NO: 16737 - DNA, 704 bp, Homo sapiens
atgaatgagtttttctccgtagacgataataatgaagaagaagaggatgttgaaatgaaagaagattcagatgagaacggtccagaggagaagcaaagtgtggaagaaatggaagagcagagccaagatgcagatggtgtcaacactgtcactgtgcccggccctgcttcagaagaggcagttgaagactgtaaagatgaagattttgcaaaggatgaaaatattacaaaaggcggtgaagtgacagatcattctgtgcgtgaccaagatcatcccgatggacaagagaatgattcaacgaagaatgaaataaaaattgaaacagaatcgcagagctcatatatggaaacagaagaactttcatcaaaccaagaagatgccgtgattgtggagcaaccagaagtgattccattaacagaggaccaagaagaaaaagaaggtgaaaaagctccaggcgaggacacacctaggatgcctgggaaaagtgaaggctccagtgacctagaaaatactccaggtcctgatgttgaaatgaatagtcaggttgacaaggtaaatgacccaacagagagtcaacaagaagatcaactaatagcaggggcacaagatgaagcgaaggaacaaagaaatggaactaaatgacaatcctcagcatcgcaaggcctctcctggctctgggggagctcgggaagatagcagcacac

SEQ ID NO: 16738 - DNA, 4425 bp, Homo sapiens
actatcgagaagcagatgacaggctcaggccttaccagggatgcacttgccacattttggaaagactacataaaaaacctttaaaaattggagccctttgggcctcaggtatccaaagagcacattttttggaaactcaacactcaggaaggtcgcatagagccagtttatgcagatgtcatccatactgtagggccaatagccaggggccatattaatggttcccacaaggaagaccttgcaaattgctataaatcatctctgaagctcgtgaaagaaaataacatccgatcagttgcatttccctgcatctcaacaggcatttatggctttcccaacgagcctgctgcagtcattgccctcaacaccattaaggaatggcttgccaagaatcaccatgaggtggatcggatcattttctgtgtcttcttagaagttgacttcaaaatctacaaaaagaaaatgaatgagtttttctccgtagacgataataatgaagaagaagaggatgttgaaatgaaagaagattcagatgagaacggtccagaggagaagcaaagtgtggaagaaatggaagagcagagccaagatgcagatggtgtcaacactgtcactgtgcccggccctgcttcagaagaggcagttgaagactgtaaagatgaagattttgcaaaggatgaaaatattacaaaaggcggtgaagtgacagatcattctgtgcgtgaccaagatcatcccgatggacaagagaatgattcaacgaagaatgaaataaaaattgaaacagaatcgcagagctcatatatggaaacagaagaactttcatcaaaccaagaagatgccgtgattgtggagcaaccagaagtgattccattaacagaggaccaagaagaaaaagaaggtgaaaaagctccaggcgaggacacacctaggatgcctgggaaaagtgaaggctccagtgacctagaaaatactccaggtcctgatgttgaaatgaatagtcaggttgacaaggtaaatgacccaacagagagtcaacaagaagatcaactaatagcaggggcacaagatgaagcgaaggaacaaagaaatggaactaaatgacaatcctcagcatcgcaaggcctctcctggctctgggggagctcgggaagatagcagcacacgctgtggaggagggtgggggtggggggaaggcaagtcccatggaaggacggggaatcctttactctaatttctccagctgcattttgttccgtttatctgcagaaaaagaaagaaaaaaaagaaaaaaaaagtttcctttaatttggtggagggacccatgttgacgcatctttcaggcattatccttgtaatttctgtcttttctcttacaactttgccccagggtcacagtggcttgattgaacactcacatgtgtatcctggcccctgtctgctttcttggttatttcacaaagctggtcacacagtggtttattcaaaggaaggggaggaagacagtggtttgataagctgcaggataaattttaggaatcaatgagcccagcagcagtataatccccagacagaggaggcaggatagaaaatgggcaaaagcctcggaaaccacttggaaaaggtctggacaatgaggtgaaaatattttcttcagggttcccaaggcacaatttgttccaagtggctaatgagaaatatggaagctgaattttttccagagcagagtgcagaggcataacagaagggtgggccctggcagccatctgggtctcttccttcctaaccatggtggcaggtgcatccttctttgacactgactttcagcagagcttacttggttcatgaggtcttcacatggagactaccagcaagaggtgactctctgctgcataactgtaaaggatggccctttgctaggtgttacagttaaaagctaagaaaaggggcagtgcatttaggacccaaacatatgcctatgaatatcaaaagctcctcctgaaattgctgtgagttttccataaaagaatatcctgtcttcacccaaggcttgacagcccacagagtggtctcatttgaaattacaggaaattagagcttttgcttgcagttctgccttcctggcctgtgtttaaatgctgtcacttgtttatgccaagttcaaggctgattcaatggttggtcccctcacccagaaaaccctgaaggggaggatacagctctgaaggggggcagcagtactaaaaacccaagatgccagtggtatagtgggcacaagggatggcgaccatgaggatgccaggcatcatcaccaatatctatcctagagccagtataaggccagatgcctacttcccacagcctccccgggttccaaagtcatgtcattgttttcagtggaaacatatcgtttgttgcatatcttcttaaatccatcttccttgtaagggctttagaactaaaacttacttatattgtttttccttaacagagggagaaaaatagtggattattatttctaaaataaaaggatgttctgctttctaaatatcccatcaaaatcttcagttttgcacttttttgatggaaaattcatcttatcttcctatgactttggttttagcctttctgaatttgttaccccttctggatggcttatttgatatactggaatagttaacaagctatacttcagcatatgcactatattctaacaaattttttttaataaaatcaagacatcagcaagaatgacatttacgtgacctcataatgtgggattatggccttctgttgctattccagtttgatatggaagcatctatatcctctattgccgttagatgttgttgcttttcagaaaagtaacgaaaaggctcattttaaagaatccaagaaacgatgtcatccaaatattgacagtttctacatttcatgccatctttataactcaattgaaagttgccgtcattcttgtgaagtatttgacaagtgcaatctgctagaagctcgtttttcttgtgactcccaaatgttagtgctacttagcctcagtaatgagttacagttgaaaaaaacatgagggaaacagagggacagagattttctaatgaacaatgatggaagagacctaatgtccttgctagaaacagccaggatggaaattatccagccctggcattctccttatcatcaatgacagtcattttattcatttatttcaaatgtgggtgggctagaagtggaaggagggaattctctctgcctaaaaattctagaagaatgaaagtaatctttgtatccaggaaactaagagaatgaggaataaatatcttcagcccgactcctgaatttgtttattcttccatctataattagattgtgttttcatttttgctttgtcatgctttttggttgttatttggctatacagttttatgctttaaaacaaatgataaagttaatttccaattcaatagtgaaatattaacaatctaactatagccagatcaaagacacctgaacacagaaaacctttatttgctggtgctgccattgcacaggctgtacaatgaaatagatttgaaaagctgattgattttcccgcacataaattctggatgtcaatttccaaccaaactccaatacagctatgtggcatgaagagttacaggagggagggaggaaaatagccctatgttagtcatgtttgcatacagaggatcaaagtaggccttcaccataatagttctaattaaaatggtcctcgctgtaggagagacaaaggggcttttcctctagctggtaactattcagatgatggacaagtcttctttcataaaagattacaaagaaggcatccgaatcactgtctgtgatactgggtcacatattaatcactgcagctaattgtaaatctttctatgaaacactgaaaagcctctttgtgaattaatacagttctgcttgatgcacttgatttgaaaagacatttctctgtatgtggcgcatgtcggctttgctttgaaaaataacaaagttagcagaatatgttcaatatattttcttggggaatagggtttttattacatgattcattaaggatttgccttaccctgacatttgtgatataaaggaaaatcagaaaaaaagtaattttcttgatcaagatatgtttttacttaatgcaaataaatgtagtctgttgcttgcaaggaaaaaaaaatggcttctgatatctggtataaactgctaaataggataatacgtgcctcttttgttaaaccggcatttaaatgctggactgcttctaaatctgtttgtttcttttcatctgtgccatacactaaaaaacaactgttgccttcatactatatttgttagagcagaatacaaataaaatttgtttgagaggataatgtgaaa

SEQ ID NO: 16739 - DNA, 2058 bp, Homo sapiens
gctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctc

SEQ ID NO: 16740 - DNA, 2222 bp, Homo sapiens
tcatttcccggcgtgcagcgcgctcgcgcgtcccccgcccgctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctca

SEQ ID NO: 16741 - DNA, 1944 bp, Homo sapiens
gctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagaacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgt

SEQ ID NO: 16742 - DNA, 1202 bp, Homo sapiens
aatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattg

SEQ ID NO: 16743 - DNA, 1340 bp, Homo sapiens
gcccgctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagggccgccaaaacaagcacgaagcaaagacgggacgaaaaagtagagcggctagtagctcccctaaagagagtttggaccttggtatggaaaccctaaaaggaaagccagaattgagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacg

SEQ ID NO: 16744 - DNA, 1444 bp, Homo sapiens
ttgcactgggagcaaagggttcctgtctgcagcacaccagctgcccggagctctgccctgtgcctgagcagcgtcagcaccgcggtgaggcggacggcccggcaggggttggaaagtccagaaaggccccgttcccgcgtagaacttgaatgcagctaagggacgtccagagaggcctttccttttctggtggcggtctggaatgtgctggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgacc

SEQ ID NO: 16745 - DNA, 1607 bp, Homo sapiens
ggcctggctcctctggggggcgtggatgtggggaggagctgctgtctgggtcagcagctgccctgctggagggagagggggtgctgcgctcatcccctgaactcagattggatagccccgggccagcgctggaggaggagcagaggcagggaggtgggaggagcgtgcgcagaggcgtgggaggcctgaggagtaagcggctggatgtggaccctgagagccactggcagggaggtggggtcttccagttgtgaagacaccgtggccccggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtc

SEQ ID NO: 16746 - DNA, 1945 bp, Homo sapiens
atgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacacctgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaacc

SEQ ID NO: 16747 - DNA, 1294 bp, Homo sapiens
gctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactctta

SEQ ID NO: 16748 - DNA, 939 bp, Homo sapiens
acaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactagga

SEQ ID NO: 16749 - DNA, 1838 bp, Homo sapiens
agagccaaagggaagtgctgcgaggtttacaaccagctgcagtggttcgatgggaaggatctttctccaagtggttcctcttgaggggagcatttctgctggctccaggactttggccatctataaagcttggcaatgagaaataagaaaattctcaaggaggacgagctcttgagtgagacccaacaagctgcttttcaccaaattgcaatggagcctttcgaaatcaatgttccaaagcccaagaggagaaatggggtgaacttctccctagctgtggtggtcatctacctgatcctgctcaccgctggcgctgggctgctggtggtccaagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccagggatgttcagaatcaaaggtgaacaaggcgccccaggtcttcaaggtcacaagggggccatgggcatgcctggtgcccctggcccgccgggaccacctgctgagaagggagccaagggggctatgggacgagatggagcaacaggcccctcgggaccccaaggcccaccgggagtcaagggagaggcgggcctccaaggaccccagggtgctccagggaagcaaggagccactggcaccccaggaccccaaggagagaagggcagcaaaggcgatgggggtctcattggcccaaaaggggaaactggaactaagggagagaaaggagacctgggtctcccaggaagcaaaggggacaggggcatgaaaggagatgcaggggtcatggggcctcctggagcccaggggagtaaaggtgacttcgggaggccaggcccaccaggtttggctggttttcctggagctaaaggagatcaaggacaacctggactgcagggtgttccgggccctcctggtgcagtgggacacccaggtgccaagggtgagcctggcagtgctggctcccctgggcgagcaggacttccagggagccccgggagtccaggagccacaggcctgaaaggaagcaaaggggacacaggacttcaaggacagcaaggaagaaaaggagaatcaggagttccaggccctgcaggtgtgaagggagaacaggggagcccagggctggcaggtcccaagggagcccctggacaagctggccagaagggagaccagggagtgaaaggatcttctggggagcaaggagtaaagggagaaaaaggtgaaagaggtgaaaactcagtgtccgtcaggattgtcggcagtagtaaccgaggccgggctgaagtttactacagtggtacctgggggacaatttgcgatgacgagtggcaaaattctgatgccattgtcttctgccgcatgctgggttactccaaaggaagggccctgtacaaagtgggagctggcactgggcagatctggctggataatgttcagtgtcggggcacggagagtaccctgtggagctgcaccaagaatagctggggccatcatgactgcagccacgaggaggacgcaggcgtggagtgcagcgtctgacccggaaaccctttcacttctctgctcccgaggtgtcctcgggctcatatgtgggaaggcagaggatctctgaggagttccctggggacaactgagcagcctctggagaggggccattaataaagctcaacatcattggc

SEQ ID NO: 16750 - DNA, 1843 bp, Homo sapiens
ataaagcttggcaatgagaaataagaaaattctcaaggaggacgagctcttgagtgagacccaacaagctgcttttcaccaaattgcaatggagcctttcgaaatcaatggatgaggagtgtaaatttcacactgtaccctctagaagcacagtgcaacttgcatccctctttcctgccatcacctccagcctccctcattagaacaagcctccttcattccattatctgcactagaattaagttccaaagcccaagaggagaaatggggtgaacttctccctagctgtggtggtcatctacctgatcctgctcaccgctggcgctgggctgctggtggtccaagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccagggatgttcagaatcaaaggtgaacaaggcgccccaggtcttcaaggtcacaagggggccatgggcatgcctggtgcccctggcccgccgggaccacctgctgagaagggagccaagggggctatgggacgagatggagcaacaggcccctcgggaccccaaggcccaccgggagtcaagggagaggcgggcctccaaggaccccagggtgctccagggaagcaaggagccactggcaccccaggaccccaaggagagaagggcagcaaaggcgatgggggtctcattggcccaaaaggggaaactggaactaagggagagaaaggagacctgggtctcccaggaagcaaaggggacaggggcatgaaaggagatgcaggggtcatggggcctcctggagcccaggggagtaaaggtgacttcgggaggccaggcccaccaggtttggctggttttcctggagctaaaggagatcaaggacaacctggactgcagggtgttccgggccctcctggtgcagtgggacacccaggtgccaagggtgagcctggcagtgctggctcccctgggcgagcaggacttccagggagccccgggagtccaggagccacaggcctgaaaggaagcaaaggggacacaggacttcaaggacagcaaggaagaaaaggagaatcaggagttccaggccctgcaggtgtgaagggagaacaggggagcccagggctggcaggtcccaagggagcccctggacaagctggccagaagggagaccagggagtgaaaggatcttctggggagcaaggagtaaagggagaaaaaggtgaaagaggtgaaaactcagtgtccgtcaggattgtcggcagtagtaaccgaggccgggctgaagtttactacagtggtacctgggggacaatttgcgatgacgagtggcaaaattctgatgccattgtcttctgccgcatgctgggttactccaaaggaagggccctgtacaaagtgggagctggcactgggcagatctggctggataatgttcagtgtcggggcacggagagtaccctgtggagctgcaccaagaatagctggggccatcatgactgcagccacgaggaggacgcaggcgtggagtgcagcgtctgacccggaaaccctttcacttctctgctcccgaggtgtcctcgggctcatatgtgggaaggcagaggatctctgaggagttccctggggacaactgagcagcctctggagaggggccattaataaagctcaacatc

SEQ ID NO: 16751 - DNA, 2132 bp, Homo sapiens
tgtgtcatttcctttcttcatgtaccagatgctgaaatactatgagataaagattttaggtttcaattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaactccatttacgaaagttcgactggtcggtgggagcggccctcacgaggggagggtggagatactccacagcggccagtggggtacaatttgtgacgatcgctgggaagtgcgcgttggacaggtcgtctgtaggagcttgggatacccaggtgttcaagccgtgcacaaggcagctcactttggacaaggtactggtccaatatggctgaatgaagtgttttgttttgggagagaatcatctattgaagaatgtaaaattcggcaatgggggacaagagcctgttcacattctgaagatgctggagtcacttgcactttataatgcatcatattttcattcacaactatgaaatcgctgctcaaaaatgattttattaccttgttcctgtaaaatccatttaatcaatatttaagagattaagaatattgcccaaataatattttagattacaggattaatatattgaacaccttcatgcttactattttatgtctatatttaaatcattttaacttctataggtttttaaatggaattttctaatataatgacttatatgctgaattgaacattttgaagtttatagcttccagattacaaaggccaagggtaatagaaatgcataccagtaattggctccaattcataatatgttcaccaggagattacaattttttgctcttcttgtctttgtaatctatttagttgattttaattactttctgaataacggaagggatcagaagatatcttttgtgcctagattgcaaaatctccaatccacacatattgttttaaaataagaatgttatccaactattaagatatctcaatgtgcaataacttgtgtattagatatcaatgttaatgatatgtcttggccactatggaccagggagcttatttttcttgtcatgtactgacaactgtttaattgaatcatgaagtaaattgaaagcaggacatatgagaaaa

SEQ ID NO: 16752 - DNA, 3572 bp, Homo sapiens
aaatttagattttgcaaacctgtgcattgatgagagtgctattgaaacacattaagaaagattttcaacgcaggaatgtgtcatttcctttcttcatgtaccagatgctgaaatactatgagataaagattttaggtttcaattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaagtactggtccaatatggctgaatgaagtgttttgttttgggagagaatcatctattgaagaatgtaaaattcggcaatgggggacaagagcctgttcacattctgaagatgctggagtcacttgcactttataatgcatcatattttcattcacaactatgaaatcgctgctcaaaaatgattttattaccttgttcctgtaaaatccatttaatcaatatttaagagattaagaatattgcccaaataatattttagattacaggattaatatattgaacaccttcatgcttactattttatgtctatatttaaatcattttaacttctataggtttttaaatggaattttctaatataatgacttatatgctgaattgaacattttgaagtttatagcttccagattacaaaggccaagggtaatagaaatgcataccagtaattggctccaattcataatatgttcaccaggagattacaattttttgctcttcttgtctttgtaatctatttagttgattttaattactttctgaataacggaagggatcagaagatatcttttgtgcctagattgcaaaatctccaatccacacatattgttttaaaataagaatgttatccaactattaagatatctcaatgtgcaataacttgtgtattagatatcaatgttaatgatatgtcttggccactatggaccagggagcttatttttcttgtcatgtactgacaactgtttaattgaatcatgaagtaaattgaaagcaggacatatgagaaaactgaccatcagtatatttgtccagataattggtggatcaaaaatgccacttaacaggaagtttagtttgttatgcactttaaatggaataattagcttgttacaattctaggacatggtgtttaaaatttaaatctgattaatccattttaacaaacaatgcaaacatcttcagtgcagaaggaagagtggtttcaactgtttggagtcttttatgaagtcagtcaacatttacaaccaaagggcgggggggggggtggggggtgcgtctttagtcctaaagggacaataactctgagcatgccccaaaaaagtagtttagcaaccttttgttggtagtcaacccatccccagggccatagtgtagagtgtgaaaagctaccctgaaacccagtaattctaccctgaaagtgactgcctgcagaaagaccagcagttgatattaaagcgcaaatgaattcaacctcagccctgaaaataacagaattctgaagtttcctatgactaattcacaaaaaaagtaattgtaaactagtactattatggaattactctactgttctttctttaatagtggcaaatgaaagcataagcttaagcattttttcatattctgaagtctcaccacacataataaccaagtggtagactcacagccgtccaacttaaaaaggcaaaaccttaccttggaattggaattactgtaaacagcctactgaaaatgcatttttatcatgtaacattcttctacttgtttaacattgctgattttctctggcagcataattttgtggttaagagaatgaattctgaatgtacactttctgtctcaaaccctggctgtaatttcagctagttaataattctttgtgttcagttccactatctaggtattttcttcaaaaggtaaatacaatggtttctgaaagaatcatttgcattatcagcctgtttgggatgtctgagatcagtgcctctgggttgttaatactgtattgctgtatggtatatgtatgctgatttactacttatgcgtaagtggtatgcatgggatgtctgaaatcagtgcctatgggttgtcaatagtattaactattagtgttaactgttagtattaactattagtattattaacactaataatagtactattactattactatttttattttaaaataaaatttacctttaaaataataatagtactattgctagtactagtactattgctattactagtactattactagtactagtactatgacactgttaatagtactattaacaacccataggcacttgggatgtctgagatcagtgcctatgggttgttaatactatattgctgtatggtatatgcatgctgatttaccacttatgcatagatatatctttaataagtaatctaaaaatcctttttgtatttgagagaatctactaagttcagtccagtcaagaaaagaacctaatagcaccaatacaaattgaggacttaatttactttggaatgttgaattgcatttgttccattaaaaaaaacagaaatttgcga

SEQ ID NO: 16753 - DNA, 1167 bp, Homo sapiens
atggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaagtactggtccaatatggctgaatgaagtgttttgttttgggagagaatcatctattgaagaatgtaaaattcggcaatgggggacaagagcctgttcacattctgaagatgctggagtcacttgcactttataa

SEQ ID NO: 16754 - DNA, 2826 bp, Homo sapiens
taggtttcaattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaagaccagtacaactcactgatcatattagggcagggccctcttaagatcaggtgggttgggcgggacatcctctgctaccatctcattaaaaggcccttcacctctggacaagtcatctgcacaactgacttccaagatccttttgtgactcctccaaatgactttggttcccgtgttgtacctgacttccacatggccttctctcctggtccctggtgctgtttgggcctctgctcccatgctcatacctcttcttactccaattactccaccatcacctctctcccctatcacccccagcctggacacctctcatgcacggactggagggctgctccaaccagtcctcagttctctgccacccattgacctagagtcttgaacccaatttaatttattgggttctaggagaactgctgtgttctcaccctaacttggaagagtgatgtttcagtcaagcaaagcgattcctaccatacaatataacacttgtgtgaggctctgtcctaaatatctcaattaccaatatgtggtttggtagtatttctcgccatgctttgctcatgcgcaatgagactacaactagggtgtaaattttaagtatcccatctaaaactcatacaatgataggaaaaatccatttgtttttcatttgatttttactgaggaatcagctcaatcttcaatgaatactggtctctttccaaagcatttttgatcaaagtaaagactgagtcaagggctttttttttttctttttcttgttttaagagacagagccttgttctattgcacaggctggactacacgcattcacctagagtctagaacacaatttaatttattgggttctaggagaactgtcatgagtattgataatatgagagttctttatattcaaacattattctcaaccagagatagggatgtcatagaagaaaatccattcattcaatcattaattcacatgtccattatgtacctccatgagctggacataacagctaataagagataattgtctctggttttacagagctaattgtccctaagagatgtagacaaatgaacaagcaattacaatacatctaagctatactgggggaggaacagggctggataggtatgcagaggagataaaaaaattttaattccttagaatattttttaaaaattgattcttattttaccttctcatcttcttattttccaaattacagcatatatatatatatatatatatatatatatatatatatatatatatatattttttttttttttttttttttttttttaagttttgaagtgtagtcgagcttgggcaatttatccaacccatttaaaccaaaaataaaacttttcatgtattacctggtcatttcaaacaaaaatattttgatcatgaaaaagaataccaatattcttttgttctaaaaatctcttatgggattacatgttatatttttggtttctctctactgatcaacagactacattttcacaactcttctttcctttacgttttaacacacagacccaagattcatactattaagattctagtagaactctagatggtatgcctctgtgtatctcagcatttttattcccactcttgtataatgaacatgttaacacctacctcacagggttgttgtgaggatcaagtaagatattgtgtgtgtgaagatgctctgtgaaatcataaagtcctttaaagatgt

SEQ ID NO: 16755 - DNA, 1513 bp, Homo sapiens
actctgctgttgagacgttggggagatgaggaggaatacccagaaataaataaaactcccctggatgtgctatctcagtgcaatcatcagtatctctcttctcaacaaaaaaccaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaactccatttacgaaagttcgactggtcggtgggagcggccctcacgaggggagggtggagatactccacagcggccagtggggtacaatttgtgacgatcgctgggaagtgcgcgttggacaggtcgtctgtaggagcttgggatacccaggtgttcaagccgtgcacaaggcagctcactttggacaaggtactggtccaatatggctgaatgaagtgttttgttttgggagagaatcatctattgaagaatgtaaaattcggcaatgggggacaagagcctgttcacattctgaagatgctggagtcacttgcactttataatgcatcatattttcattcacaactatgaaatcgctgctc

SEQ ID NO: 16756 - DNA, 353 bp, Homo sapiens
ctcagggttatagaacagccgccttcagctattctcccccagggctctgcagaaccttcccacctttcagcaggctggagtgcagtggcatgatcgtgactcactgcagccttccactcctgggctcaagcaatcctactgcctcaggctcccagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcat

SEQ ID NO: 16757 - DNA, 955 bp, Homo sapiens
aattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgagaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaagaccagtacaactcactgatcatattagggcagggccctcttaagatcaggtgggttgggcgggacatcctctgctaccatctcattaaaaggcccttcacctctggacaagtcatctgcacaactgacttccaagatccttttgtgactcctccaaatgactttggttcccgtgttgtacctgacttccacatggccttctctcctggtccctggtgctgtttgggcctctgctcccatgctcatacctcttcttactccaattactccaccatcacctctctcccctatcacccccagcctggacacctctcatgcacggactggagggctgctccaaccagtcctcagttctctgccacccattgacctagagtcttgaacccaattt

SEQ ID NO: 16758 - DNA, 4536 bp, Homo sapiens
ggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccaaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcagcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaa

SEQ ID NO: 16759 - DNA, 4198 bp, Homo sapiens
atggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccaaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcagcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccatta

SEQ ID NO: 16760 - DNA, 2500 bp, Homo sapiens
gtcgcgataaatgggcgccggcggagcggagggagatccgagcggcggcggcaagctggctgcgagcggctgaggaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcagctggaggaaagagcagagcagatccgttcgaagtcccacctcatccaggtggagcgggagaaaatgcagatggagctgagtcacaagagggctcgagtggagctggagagagcagccagcaccagtgccaggaactacgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataa

SEQ ID NO: 16761 - DNA, 2762 bp, Homo sapiens
gcaggtctcgcgagagcgcaggcgcaagtgtcgcgataaatgggcgccggcggagcggagggagatccgagcggcggcggcaagctggctgcgagcggctgaggagctgggatacactcttcctctcctctcctcaacagcagcactccaagctcgccggcctttggtctccaggacttgtcccagcagcccctcgaactgagaattacaccatcggacccctggctctgaggccttcagacttggactgtgtcacactgccaggcttccagggctccaacttgcagacggcctgttgtgggacagtctctgtaatcgcgaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcagctggaggaaagagcagagcagatccgttcgaagtcccacctcatccaggtggagcgggagaaaatgcagatggagctgagtcacaagagggctcgagtggagctggagagagcagccagcaccagtgccaggaactacgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctagac

SEQ ID NO: 16762 - DNA, 2355 bp, Homo sapiens
gtcgcgataaatgggcgccggcggagcggagggagatccgagcggcggcggcaagctggctgcgagcggctgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagggtcctgattgtcacgctccttactctggaattatcttatgcgcctcttccttgccaactgtccggcgtcccctacaacacgggtgaccctgtgggcaggtgggctcggccctgcatctggccttgcccctggcacacgaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctagac

SEQ ID NO: 16763 - DNA, 2991 bp, Homo sapiens
gcaaaattttgggaagagtcaacggtgcaagtttgtccgaggaggctgccgtgggcgcggctattccacacattacggcgcgaggcgaaagccttagtggaagcgcgtcctgcgcaaagccggggggcccccgactgcgccttggctcagccttcggttccgagtcctttccgtgcggagtctcccaggggtggcggctccgggtgcggacgcggagtccccaggatcagccggtgcgcagactcggttctttacggcccgattgccacgcaggtctcgcgagagcgcaggcgcaagtgtcgcgataaatgggcgccggcggagcggagggagatccgagcggcggcggcaagctggctgcgagcggctgagcactccaagctcgccggcctttggtctccaggacttgtcccagcagcccctcgaactgagaattacaccatcggacccctggctctgaggccttcagacttggactgtgtcacactgccaggcttccagggctccaacttgcagacggcctgttgtgggacagtctctgtaatcgcgaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcagctggaggaaagagcagagcagatccgttcgaagtcccacctcatccaggtggagcgggagaaaatgcagatggagctgagtcacaagagggctcgagtggagctggagagagcagccagcaccagtgccaggaactacgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctagac

SEQ ID NO: 16764 - DNA, 555 bp, Homo sapiens
gtcgcgataaatgggcgccggcggagcggagggagatccgagcggcggcggcaagctggctgcgagcggctgaggaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcagctggaggaaagagcagagcagatccgttcgaagtcccacctcatccaggtggagcgggagaaaatgcagatggagctgagtcacaagagggctcgagtggagctggagagagcagccagcaccagtgccaggaactacgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgag

SEQ ID NO: 16765 - DNA, 1086 bp, Homo sapiens
atgagagaacttgagtttgcaaagttagagtgctgtctggcctggcagcttcaggcttccaggagagagctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctagac

SEQ ID NO: 16766 - DNA, 1654 bp, Homo sapiens
ggaatcgtcatcttcttccctcggccccaactagtagaccacgaccagaagacacatcctaacctacacctaccgtagtgtcacacccggcacagcgcgaccaggtccaccaactgcgcctgcgcgaaccggccgctcccgcgacatcacaggaaggctgagagaaagggcaggtccccgctgcgtggggctgggcttaaaggctcgtcgcgcctgcgcaaaggacctgacgacgtgctgcgtcgttacttttgaaacgcttggcggggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagattggttatacaagtgttcagttcagaaactggttgtagttatctcaaatattgaaagtggtgaggtcctggaaagatggcagtttgatattgagtgtgacaagactgcaaaagatgacagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaagtcatctatagttgatatgttttatttcattggttaatttttacatggagaaaaccaaaatgatacttactgaactgtgtgtaattgttccttttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaatttgtcttaaaa

SEQ ID NO: 16767 - DNA, 1626 bp, Homo sapiens
gcaggcgcctacctctgttacttagggcgggagcccggcgagggcgccggtgctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgtgaacagcgcttcctcccttgtgaaattggctgtgttaagtattctctccaagaaggtattatggcagatttccacagttttataaatcctggtgaaattccacgaggatttcgatttcattgtcaggctgcaagtgattctagtcacaagattcctatttcaaattttgaacgtgggcataaccaagcaactgtgttacaaaacctttatagatttattcatcccaacccagggaactggccacctatctactgcaagtctgatgatagaaccagagtcaactggtgtttgaagcatatggcaaaggcatcagaaatcaggcaagatctacaacttctcactgtagaggaccttgtagtggggatctaccaacaaaaatttctcaaggagccctctaagacttggattcgaagcctcctagatgtggccatgtgggattattctagcaacacaaggtgcaagtggcatgaagaaaatgatattctcttctgtgctttagctgtttgcaagaagattgcgtactgcatcagtaattctctggccactctctttggaatccagctcacagaggctcatgtaccactacaagattatgaggccagcaatagtgtgacacccaaaatggttgtattggatgcagggcgttaccagaagctaagggttgggagttcaggattctctcatttcaactcttctaatgaggaacaaagatcaaacacacccattggtgactacccatctagggcaaaaatttctggccaaaacagcagcgttcggggaagaggaattacccgcttactagagagcatttccaattcttccagcaatatccacaaattctccaactgtgacacttcactctcaccttacatgtcccaaaaagatggatacaaatctttctcttccttatcttaatgatggtactcttttcaatttctgaaaacagtaacaggcccaacttccttcttactacagtcatattaaacagatcacatcaatgacaaatgtcactactataaaaactacttaatttgtaaggaaattgtttcatagatttaaaaaaattgtggttggagagcatcttggcatttgtgctttttttcttgagggattgttctgcttcctggctgtatgatgggtatatcattaaagtttggagtcctatatgaacaaaactgacatttttagagttgtacttttgggaatgttatagattgatcattctttctcctgataa

SEQ ID NO: 16768 - DNA, 1908 bp, Homo sapiens
agagcacttggcacctgcgacggcgctctccccccacctcacccgcaaggcggcacgagccggaatcttccagtctcaggctgtttgttcccccgcggggcaatgcgactgcgcgtcgcttcctgattggccgagagttgcgggctgcgtgcgcaggcgcctacctctgttacttagggcgggagcccggcgagggcgccggtgctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgcttctgagggaggaagaaaaggagaaatacgcagaaatggctcgagaatggagggccgctcagggaaaggaccctgggccctcagagaagcagaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgtgaacagcgcttcctcccttgtgaaattggctgtgttaagtattctctccaagaaggtattatggcagatttccacagttttataaatcctggtgaaattccacgaggatttcgatttcattgtcaggctgcaagtgattctagtcacaagattcctatttcaaattttgaacgtgggcataaccaagcaactgtgttacaaaacctttatagatttattcatcccaacccagggaactggccacctatctactgcaagtctgatgatagaaccagagtcaactggtgtttgaagcatatggcaaaggcatcagaaatcaggcaagatctacaacttctcactgtagaggaccttgtagtggggatctaccaacaaaaatttctcaaggagccctctaagacttggattcgaagcctcctagatgtggccatgtgggattattctagcaacacaaggtgcaagtggcatgaagaaaatgatattctcttctgtgctttagctgtttgcaagaagattgcgtactgcatcagtaattctctggccactctctttggaatccagctcacagaggctcatgtaccactacaagattatgaggccagcaatagtgtgacacccaaaatggttgtattggatgcagggcgttaccagaagctaagggttgggagttcaggattctctcatttcaactcttctaatgaggaacaaagatcaaacacacccattggtgactacccatctagggcaaaaatttctggccaaaacagcagcgttcggggaagaggaattacccgcttactagagagcatttccaattcttccagcaatatccacaaattctccaactgtgacacttcactctcaccttacatgtcccaaaaagatggatacaaatctttctcttccttatcttaatgatggtactcttttcaatttctgaaaacagtaacaggcccaacttccttcttactacagtcatattaaacagatcacatcaatgacaaatgtcactactataaaaactacttaatttgtaaggaaattgtttcatagatttaaaaaaattgtggttggagagcatcttggcatttgtgctttttttcttgagggattgttctgcttcctggctgtatgatgggtatatcattaaagtttggagtcctatatgaacaaaactgacatttttagagttgtacttttgggaatgttatagattgatcattctttctcctgataataaaggtattgaatatctgttatgaaaggttctaaaa

SEQ ID NO: 16769 - DNA, 1013 bp, Homo sapiens
cgggagcccggcgagggcgccggtgctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgtgaacagcgcttcctcccttgtgaaattggctgtgttaagtattctctccaagaaggtattatggcagatttccacagttttataaatcctggtgaaattccacgaggatttcgatttcattgtcaggctgcaagtgattctagtcacaagattcctatttcaaattttgaacgtgggcataaccaagcaactgtgttacaaaacctttatagatttattcatcccaacccagggaactggccacctatctactgcaagtctgatgatagaaccagagtcaactggtgtttgaagcatatggcaaaggcatcagaaatcaggcaagatctacaacttctcactgtagaggaccttgtagtggggatctaccaacaaaaatttctcaaggagccctctaagacttggattcgaagcctcctagatgtggccatgtgggattattctagcaacacaaggtgcaagtggcatgaagaaaatgatattctcttctgtgctttagctgtttgcaagaagattgcgtactgcatcagtaattctctggccactctctttggaatccagctcacagaggctcatgtaccactacaagattatgaggccagcaatagtgtgacacccaaaatggttgtattggatgcagggcgttaccag

SEQ ID NO: 16770 - DNA, 793 bp, Homo sapiens
ctacttcagaggtgcaagtggcatgaagaaaatgatattctcttctgtgctttagctgtttgcaagaagattgcgtactgcatcagtaattctctggccactctctttggaatccagctcacagaggctcatgtaccactacaagattatgaggccagcaatagtgtgacacccaaaatggttgtattggatgcagggcgttaccagaagctaagggttgggagttcaggattctctcatttcaactcttctaatgaggaacaaagatcaaacacacccattggtgactacccatctagggcaaaaatttctggccaaaacagcagcgttcggggaagaggaattacccgcttactagagagcatttccaattcttccagcaatatccacaaattctccaactgtgacacttcactctcaccttacatgtcccaaaaagatggatacaaatctttctcttccttatcttaatgatggtactcttttcaatttctgaaaacagtaacaggcccaacttccttcttactacagtcatattaaacagatcacatcaatgacaaatgtcactactataaaaactacttaatttgtaaggaaattgtttcatagatttaaaaaaattgtggttggagagcatcttggcatttgtgctttttttcttgagggattgttctgcttcctggctgtatgatgggtatatcattaaagtttggagtcctatatgaacaaaactgacatttttagagttgtacttttgggaatgttatagattgatcattctttctcctgataa

SEQ ID NO: 16771 - DNA, 1156 bp, Homo sapiens
attcatattcacccttcatgaggatgagcacagagcaagaagctagccacgctgggctcctcattgcctagctcaggaattcagggctgggaaaatttagccgagtcatcacatttggctactacccgggaaagcagccctcccgagtcaggaacgggctccggttcatcacgtggcagccgcctgcaggagccgcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgagaacgacagtctgagatactcggcctttgttttgtttgggcaattggctgcctttgccgggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcactta

SEQ ID NO: 16772 - DNA, 5257 bp, Homo sapiens
aacgggccttggcagggaggttttgtttggtgcagaggaaaggtccccagaattgccatctgcagaatttctgcagaaagtgtcgaccaggctggcatgagggaagaaggaggggaaatcacagcaaggagaaggaaaaacacctcagcatggcgtggggaagcaaaggaattcagggctgggaaaatttagccgagtcatcacatttggctactacccgggaaagcagccctcccgagtcaggaacgggctccggttcatcacgtggcagccgcctgcaggagccgcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgagaacgacagtctgagatactcggcctttgttttgtttgggcaattggctgcctttgccgggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggagaatacttgttaccttaagcgtttttttgtttttttgttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatgctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccagataactcagtaaacagtggagctggaattcaaacatgtacggtctgacttcttgagcccatactcaataatcatgccatcctgcctttccatggaataactgatggatggttagaaatgttaaaaacaaagcaaatgcaaacatctctgcttctgctcctctactaagcccagttaacttttgattttatatgtactaagtatacatttttattaatttatgtgagctgagtgtttttattaattactttttggctattaatgtcaattattttggtgatcaatcctagttatccaaggagtcacatcactcgtaaaaattacaagaaaaatctctaagtccctctcaccctccctctaaccagattgcatcccaagcttctatagaaactctggtaccacccctgaattcagtatccaggccacacccggagcgttttgttcaagacaatttaaaacacgggggattataaaagctatagctggatcttaagtggcattctgagaatgaggaactcaattttctgctgtagctcccagggacagggtggtgtgacacagatgcggggatgaggagagacctaggcgagatgaggatgtgggagatggcagacagagtggcaagtgccaggcaggaatggattttcttccttcctgttctgaatctgaagaacatgacagcaagagattttaggagggacacaggctcacgagcaaatgggtggttctgagctgtaagccccctgcccctccctagcacccactccccggatgctggcctctttgaaattttgttgcaaggttggtttaaacttgatgcagttccattaagtgatcagtgagtggtctgagaaatggctgcatgtggctggcattcaaaaaggtggggatagggtgagatgggtggggttacgtgctctggagtagaaaaacctatgcagttaatgtccctctgtcggttaaaattgtggaagatgcggttggattatttgactttaagattcaatggtaggcttttattttggtggcccccaatgagtcatgcctcctgatactcatgtctttatttagtcccttctgtttgaatctgggctgcctttgtgacttgctttaatcaggagattgtgataaatggcactgtgccgggcatagaaaccctggcagtttcctcgtttgaattgtgggggaagccagctgccacataaggagttgaactaccaggaacaaatgagagtgcctgagatcaccatgtgaaggagaacggagacacccaacccacagcagagtctgaggcccggacacatgacacaagttgtcccttccagccagacccgagctgttgaagctactccagctgacaccatacggaaaagagacgagcgtctccatcaagcctgtgtcagttgcagaagcatgaacaaagaatcaaatgattgttgttttaagtcattaacctttgggataatttgtcacactgcaataagtaaccagagaagattccttattattaactgttgtcttggctaattttgttttgctcttcataagtcctctttgagtttaaattctatttccagaaatttatgttatcatgaaatttggtggcaagagcaagggactatgtttttttgtttgtttgtttctgtttctcaccatacctaccacagagcctggccatgtgattaaggaacatttgctgaatgactaaatgattccaaattgtagagggaataaagtccaatgtccagtctgccatttcaggctttcaaccttcgttttcttctgttactctctttgcttcagacaagtttgggtcctttctcttctctcaacatgtcttgttctcctataccccctcacctttgctcagtctgctatttctgtgttgagtcccctccctgctcacctgtacacacccacctggaatcacatgcacacacacacacacacatttcacgtgtatctcttatctgtactccaatgcctaggtcaaagtcctgatccccccaatcaggggagagctcaagtctctgaattcccagaacattctagcaatattataccacttatatcttatctgaaaagtttttttttgtatatggctttatgtttttttttttatcctgttagattgaaactacagaaggcagggctgtatcttgtacatcattgtatctccccggtgactgcaaaagtactctgtaaatgaatgttgattagggggaaaaatgtcagaaagtcatctgaagctgtcattccttactgggaggagcccattttgacaaatgagggtcaccaatttcattccttataaccaatgtacaggttacttttatgcttgtgcatttcaagtttccccttccccacgtttatctgaatgccaacccaaaggtaatgttttgacatttcttaattttgaacattaattttgaaccttattgagcagttgaatgaaagaaagaaaaaaggaatgttcaagtgccccgaccctcatgctaagtgcccagggtagagctttgcttggtccctgtgtctctggtgctcatgagataggtctttctttctttatttttatttttgagatggagcctcactctgtcacccaggctggagtgcaatgacacgatctcggctcactgcaacctccacctcctgggttcaagcgattctcctgtctcagcctcctgagtagctgggattacaggtgcctgccaccatggctggctaatttttgtgtttttagtagagacggggtttcaccatgttggccaggctggtctcaaactcctgacctcaagtgatctgctcaccttggtctcccaaagtgctgggattacaggcgtgagccaccgctcctggctgagataggtctttcttaaaggggagagggaagtggtggagagagaggagagaaaatgacaaaggaggaggctgagaatctaacaggtgtgaccaattctgctactgaatgagagcagaagcctgtgaacttccagttaatagaccacttaattgggggaacgcttcacacgttataaaaaagcactagaatgttttgaaagcgagaaacaacagctgtgtagggtagctagcagttagtgttgtacagaagacagatatttgtgcatttctgcattttctaagtttgctgcaatgagcatgtattactttcatagttataaaacacatgcaaaatgcccttttaaaatgaaaaaaaagtccatgagtgtaagtgatatatatgctttggaaagcctgggacggtcattgtttactctcaatagtatgtgtttgcctttgtctttttgagacattttgttttaatctgttgatgacaataacctgttgataatataacttgataacaaataaaatgacttatgattgattatcatttt

SEQ ID NO: 16773 - DNA, 4887 bp, Homo sapiens
attcatattcacccttcatgaggatgagcacagagcaagaagctagccacgctgggctcctcattgcctagctcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggagaatacttgttaccttaagcgtttttttgtttttttgttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatgctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccagataactcagtaaacagtggagctggaattcaaacatgtacggtctgacttcttgagcccatactcaataatcatgccatcctgcctttccatggaataactgatggatggttagaaatgttaaaaacaaagcaaatgcaaacatctctgcttctgctcctctactaagcccagttaacttttgattttatatgtactaagtatacatttttattaatttatgtgagctgagtgtttttattaattactttttggctattaatgtcaattattttggtgatcaatcctagttatccaaggagtcacatcactcgtaaaaattacaagaaaaatctctaagtccctctcaccctccctctaaccagattgcatcccaagcttctatagaaactctggtaccacccctgaattcagtatccaggccacacccggagcgttttgttcaagacaatttaaaacacgggggattataaaagctatagctggatcttaagtggcattctgagaatgaggaactcaattttctgctgtagctcccagggacagggtggtgtgacacagatgcggggatgaggagagacctaggcgagatgaggatgtgggagatggcagacagagtggcaagtgccaggcaggaatggattttcttccttcctgttctgaatctgaagaacatgacagcaagagattttaggagggacacaggctcacgagcaaatgggtggttctgagctgtaagccccctgcccctccctagcacccactccccggatgctggcctctttgaaattttgttgcaaggttggtttaaacttgatgcagttccattaagtgatcagtgagtggtctgagaaatggctgcatgtggctggcattcaaaaaggtggggatagggtgagatgggtggggttacgtgctctggagtagaaaaacctatgcagttaatgtccctctgtcggttaaaattgtggaagatgcggttggattatttgactttaagattcaatggtaggcttttattttggtggcccccaatgagtcatgcctcctgatactcatgtctttatttagtcccttctgtttgaatctgggctgcctttgtgacttgctttaatcaggagattgtgataaatggcactgtgccgggcatagaaaccctggcagtttcctcgtttgaattgtgggggaagccagctgccacataaggagttgaactaccaggaacaaatgagagtgcctgagatcaccatgtgaaggagaacggagacacccaacccacagcagagtctgaggcccggacacatgacacaagttgtcccttccagccagacccgagctgttgaagctactccagctgacaccatacggaaaagagacgagcgtctccatcaagcctgtgtcagttgcagaagcatgaacaaagaatcaaatgattgttgttttaagtcattaacctttgggataatttgtcacactgcaataagtaaccagagaagattccttattattaactgttgtcttggctaattttgttttgctcttcataagtcctctttgagtttaaattctatttccagaaatttatgttatcatgaaatttggtggcaagagcaagggactatgtttttttgtttgtttgtttctgtttctcaccatacctaccacagagcctggccatgtgattaaggaacatttgctgaatgactaaatgattccaaattgtagagggaataaagtccaatgtccagtctgccatttcaggctttcaaccttcgttttcttctgttactctctttgcttcagacaagtttgggtcctttctcttctctcaacatgtcttgttctcctataccccctcacctttgctcagtctgctatttctgtgttgagtcccctccctgctcacctgtacacacccacctggaatcacatgcacacacacacacacacatttcacgtgtatctcttatctgtactccaatgcctaggtcaaagtcctgatccccccaatcaggggagagctcaagtctctgaattcccagaacattctagcaatattataccacttatatcttatctgaaaagtttttttttgtatatggctttatgtttttttttttatcctgttagattgaaactacagaaggcagggctgtatcttgtacatcattgtatctccccggtgactgcaaaagtactctgtaaatgaatgttgattagggggaaaaatgtcagaaagtcatctgaagctgtcattccttactgggaggagcccattttgacaaatgagggtcaccaatttcattccttataaccaatgtacaggttacttttatgcttgtgcatttcaagtttccccttccccacgtttatctgaatgccaacccaaaggtaatgttttgacatttcttaattttgaacattaattttgaaccttattgagcagttgaatgaaagaaagaaaaaaggaatgttcaagtgccccgaccctcatgctaagtgcccagggtagagctttgcttggtccctgtgtctctggtgctcatgagataggtctttctttctttatttttatttttgagatggagcctcactctgtcacccaggctggagtgcaatgacacgatctcggctcactgcaacctccacctcctgggttcaagcgattctcctgtctcagcctcctgagtagctgggattacaggtgcctgccaccatggctggctaatttttgtgtttttagtagagacggggtttcaccatgttggccaggctggtctcaaactcctgacctcaagtgatctgctcaccttggtctcccaaagtgctgggattacaggcgtgagccaccgctcctggctgagataggtctttcttaaaggggagagggaagtggtggagagagaggagagaaaatgacaaaggaggaggctgagaatctaacaggtgtgaccaattctgctactgaatgagagcagaagcctgtgaacttccagttaatagaccacttaattgggggaacgcttcacacgttataaaaaagcactagaatgttttgaaagcgagaaacaacagctgtgtagggtagctagcagttagtgttgtacagaagacagatatttgtgcatttctgcattttctaagtttgctgcaatgagcatgtattactttcatagttataaaacacatgcaaaatgcccttttaaaatgaaaaaaaagtccatgagtgtaagtgatatatatgctttggaaagcctgggacggtcattgtttactctcaatagtatgtgtttgcctttgtctttttgagacattttgttttaatctgttgatgacaataacctgttgataatataacttgataacaaataaaatgacttatgattgattatcatttt

SEQ ID NO: 16774 - DNA, 4998 bp, Homo sapiens
aacgggccttggcagggaggttttgtttggtgcagaggaaaggtccccagaattgccatctgcagaatttctgcagaaagtgtcgaccaggctggcatgagggaagaaggaggggaaatcacagcaaggagaaggaaaaacacctcagcatggcgtggggaagcaaaggaattcagggctgggaaaatttagccgagtcatcacatttggctactacccgggaaagcagccctcccgagtcaggaacgggctccggttcatcacgtggcagccgcctgcaggagccgcaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggagaatacttgttaccttaagcgtttttttgtttttttgttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatgctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccagataactcagtaaacagtggagctggaattcaaacatgtacggtctgacttcttgagcccatactcaataatcatgccatcctgcctttccatggaataactgatggatggttagaaatgttaaaaacaaagcaaatgcaaacatctctgcttctgctcctctactaagcccagttaacttttgattttatatgtactaagtatacatttttattaatttatgtgagctgagtgtttttattaattactttttggctattaatgtcaattattttggtgatcaatcctagttatccaaggagtcacatcactcgtaaaaattacaagaaaaatctctaagtccctctcaccctccctctaaccagattgcatcccaagcttctatagaaactctggtaccacccctgaattcagtatccaggccacacccggagcgttttgttcaagacaatttaaaacacgggggattataaaagctatagctggatcttaagtggcattctgagaatgaggaactcaattttctgctgtagctcccagggacagggtggtgtgacacagatgcggggatgaggagagacctaggcgagatgaggatgtgggagatggcagacagagtggcaagtgccaggcaggaatggattttcttccttcctgttctgaatctgaagaacatgacagcaagagattttaggagggacacaggctcacgagcaaatgggtggttctgagctgtaagccccctgcccctccctagcacccactccccggatgctggcctctttgaaattttgttgcaaggttggtttaaacttgatgcagttccattaagtgatcagtgagtggtctgagaaatggctgcatgtggctggcattcaaaaaggtggggatagggtgagatgggtggggttacgtgctctggagtagaaaaacctatgcagttaatgtccctctgtcggttaaaattgtggaagatgcggttggattatttgactttaagattcaatggtaggcttttattttggtggcccccaatgagtcatgcctcctgatactcatgtctttatttagtcccttctgtttgaatctgggctgcctttgtgacttgctttaatcaggagattgtgataaatggcactgtgccgggcatagaaaccctggcagtttcctcgtttgaattgtgggggaagccagctgccacataaggagttgaactaccaggaacaaatgagagtgcctgagatcaccatgtgaaggagaacggagacacccaacccacagcagagtctgaggcccggacacatgacacaagttgtcccttccagccagacccgagctgttgaagctactccagctgacaccatacggaaaagagacgagcgtctccatcaagcctgtgtcagttgcagaagcatgaacaaagaatcaaatgattgttgttttaagtcattaacctttgggataatttgtcacactgcaataagtaaccagagaagattccttattattaactgttgtcttggctaattttgttttgctcttcataagtcctctttgagtttaaattctatttccagaaatttatgttatcatgaaatttggtggcaagagcaagggactatgtttttttgtttgtttgtttctgtttctcaccatacctaccacagagcctggccatgtgattaaggaacatttgctgaatgactaaatgattccaaattgtagagggaataaagtccaatgtccagtctgccatttcaggctttcaaccttcgttttcttctgttactctctttgcttcagacaagtttgggtcctttctcttctctcaacatgtcttgttctcctataccccctcacctttgctcagtctgctatttctgtgttgagtcccctccctgctcacctgtacacacccacctggaatcacatgcacacacacacacacacatttcacgtgtatctcttatctgtactccaatgcctaggtcaaagtcctgatccccccaatcaggggagagctcaagtctctgaattcccagaacattctagcaatattataccacttatatcttatctgaaaagtttttttttgtatatggctttatgtttttttttttatcctgttagattgaaactacagaaggcagggctgtatcttgtacatcattgtatctccccggtgactgcaaaagtactctgtaaatgaatgttgattagggggaaaaatgtcagaaagtcatctgaagctgtcattccttactgggaggagcccattttgacaaatgagggtcaccaatttcattccttataaccaatgtacaggttacttttatgcttgtgcatttcaagtttccccttccccacgtttatctgaatgccaacccaaaggtaatgttttgacatttcttaattttgaacattaattttgaaccttattgagcagttgaatgaaagaaagaaaaaaggaatgttcaagtgccccgaccctcatgctaagtgcccagggtagagctttgcttggtccctgtgtctctggtgctcatgagataggtctttctttctttatttttatttttgagatggagcctcactctgtcacccaggctggagtgcaatgacacgatctcggctcactgcaacctccacctcctgggttcaagcgattctcctgtctcagcctcctgagtagctgggattacaggtgcctgccaccatggctggctaatttttgtgtttttagtagagacggggtttcaccatgttggccaggctggtctcaaactcctgacctcaagtgatctgctcaccttggtctcccaaagtgctgggattacaggcgtgagccaccgctcctggctgagataggtctttcttaaaggggagagggaagtggtggagagagaggagagaaaatgacaaaggaggaggctgagaatctaacaggtgtgaccaattctgctactgaatgagagcagaagcctgtgaacttccagttaatagaccacttaattgggggaacgcttcacacgttataaaaaagcactagaatgttttgaaagcgagaaacaacagctgtgtagggtagctagcagttagtgttgtacagaagacagatatttgtgcatttctgcattttctaagtttgctgcaatgagcatgtattactttcatagttataaaacacatgcaaaatgcccttttaaaatgaaaaaaaagtccatgagtgtaagtgatatatatgctttggaaagcctgggacggtcattgtttactctcaatagtatgtgtttgcctttgtctttttgagacattttgttttaatctgttgatgacaataacctgttgataatataacttgataacaaataaaatgacttatgattgattatcatttt

SEQ ID NO: 16775 - DNA, 5154 bp, Homo sapiens
aacgggccttggcagggaggttttgtttggtgcagaggaaaggtccccagaattgccatctgcagaatttctgcagaaagtgtcgaccaggctggcatgagggaagaaggaggggaaatcacagcaaggagaaggaaaaacacctcagcatggcgtggggaagcaaaggaattcagggctgggaaaatttagccgagtcatcacatttggctactacccgggaaagcagccctcccgagtcaggaacgggctccggttcatcacgtggcagccgcctgcaggagccgcaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgagaacgacagtctgagatactcggcctttgttttgtttgggcaattggctgcctttgccgggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggagaatacttgttaccttaagcgtttttttgtttttttgttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatgctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccagataactcagtaaacagtggagctggaattcaaacatgtacggtctgacttcttgagcccatactcaataatcatgccatcctgcctttccatggaataactgatggatggttagaaatgttaaaaacaaagcaaatgcaaacatctctgcttctgctcctctactaagcccagttaacttttgattttatatgtactaagtatacatttttattaatttatgtgagctgagtgtttttattaattactttttggctattaatgtcaattattttggtgatcaatcctagttatccaaggagtcacatcactcgtaaaaattacaagaaaaatctctaagtccctctcaccctccctctaaccagattgcatcccaagcttctatagaaactctggtaccacccctgaattcagtatccaggccacacccggagcgttttgttcaagacaatttaaaacacgggggattataaaagctatagctggatcttaagtggcattctgagaatgaggaactcaattttctgctgtagctcccagggacagggtggtgtgacacagatgcggggatgaggagagacctaggcgagatgaggatgtgggagatggcagacagagtggcaagtgccaggcaggaatggattttcttccttcctgttctgaatctgaagaacatgacagcaagagattttaggagggacacaggctcacgagcaaatgggtggttctgagctgtaagccccctgcccctccctagcacccactccccggatgctggcctctttgaaattttgttgcaaggttggtttaaacttgatgcagttccattaagtgatcagtgagtggtctgagaaatggctgcatgtggctggcattcaaaaaggtggggatagggtgagatgggtggggttacgtgctctggagtagaaaaacctatgcagttaatgtccctctgtcggttaaaattgtggaagatgcggttggattatttgactttaagattcaatggtaggcttttattttggtggcccccaatgagtcatgcctcctgatactcatgtctttatttagtcccttctgtttgaatctgggctgcctttgtgacttgctttaatcaggagattgtgataaatggcactgtgccgggcatagaaaccctggcagtttcctcgtttgaattgtgggggaagccagctgccacataaggagttgaactaccaggaacaaatgagagtgcctgagatcaccatgtgaaggagaacggagacacccaacccacagcagagtctgaggcccggacacatgacacaagttgtcccttccagccagacccgagctgttgaagctactccagctgacaccatacggaaaagagacgagcgtctccatcaagcctgtgtcagttgcagaagcatgaacaaagaatcaaatgattgttgttttaagtcattaacctttgggataatttgtcacactgcaataagtaaccagagaagattccttattattaactgttgtcttggctaattttgttttgctcttcataagtcctctttgagtttaaattctatttccagaaatttatgttatcatgaaatttggtggcaagagcaagggactatgtttttttgtttgtttgtttctgtttctcaccatacctaccacagagcctggccatgtgattaaggaacatttgctgaatgactaaatgattccaaattgtagagggaataaagtccaatgtccagtctgccatttcaggctttcaaccttcgttttcttctgttactctctttgcttcagacaagtttgggtcctttctcttctctcaacatgtcttgttctcctataccccctcacctttgctcagtctgctatttctgtgttgagtcccctccctgctcacctgtacacacccacctggaatcacatgcacacacacacacacacatttcacgtgtatctcttatctgtactccaatgcctaggtcaaagtcctgatccccccaatcaggggagagctcaagtctctgaattcccagaacattctagcaatattataccacttatatcttatctgaaaagtttttttttgtatatggctttatgtttttttttttatcctgttagattgaaactacagaaggcagggctgtatcttgtacatcattgtatctccccggtgactgcaaaagtactctgtaaatgaatgttgattagggggaaaaatgtcagaaagtcatctgaagctgtcattccttactgggaggagcccattttgacaaatgagggtcaccaatttcattccttataaccaatgtacaggttacttttatgcttgtgcatttcaagtttccccttccccacgtttatctgaatgccaacccaaaggtaatgttttgacatttcttaattttgaacattaattttgaaccttattgagcagttgaatgaaagaaagaaaaaaggaatgttcaagtgccccgaccctcatgctaagtgcccagggtagagctttgcttggtccctgtgtctctggtgctcatgagataggtctttctttctttatttttatttttgagatggagcctcactctgtcacccaggctggagtgcaatgacacgatctcggctcactgcaacctccacctcctgggttcaagcgattctcctgtctcagcctcctgagtagctgggattacaggtgcctgccaccatggctggctaatttttgtgtttttagtagagacggggtttcaccatgttggccaggctggtctcaaactcctgacctcaagtgatctgctcaccttggtctcccaaagtgctgggattacaggcgtgagccaccgctcctggctgagataggtctttcttaaaggggagagggaagtggtggagagagaggagagaaaatgacaaaggaggaggctgagaatctaacaggtgtgaccaattctgctactgaatgagagcagaagcctgtgaacttccagttaatagaccacttaattgggggaacgcttcacacgttataaaaaagcactagaatgttttgaaagcgagaaacaacagctgtgtagggtagctagcagttagtgttgtacagaagacagatatttgtgcatttctgcattttctaagtttgctgcaatgagcatgtattactttcatagttataaaacacatgcaaaatgcccttttaaaatgaaaaaaaagtccatgagtgtaagtgatatatatgctttggaaagcctgggacggtcattgtttactctcaatagtatgtgtttgcctttgtctttttgagacattttgttttaatctgttgatgacaataacctgttgataatataacttgataacaaataaaatgacttatgattgattatcatttt

SEQ ID NO: 16776 - DNA, 866 bp, Homo sapiens
atattcacccttcatgaggatgagcacagagcaagaagctagccacgctgggctcctcattgcctagctcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgct

SEQ ID NO: 16777 - DNA, 1677 bp, Homo sapiens
gttgtccggccgggggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcccgagcggaggccgcggcgccgccctccgatcttgaagagcccgcgctgcgcggagcccgcccccgcctgcgcaccggcaccgacgcggagcgacccagcccagccagacccggcccggcgcggcctgatctaacccagccaggcaggcaatactagcccctctggagcacggagctccttccccaaagacatgaagctattggagaactcgagctttgaagccatcaactcacagctgactgtggagactggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcgggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgactta

SEQ ID NO: 16778 - DNA, 737 bp, Homo sapiens
gacgtggcccaggcgggcgctgcctggtgactgcagcgccccagcggggccgagggaccgccctcctaggcgtctggagaaactaggcaatttttccgggtagagtggaggaacctgtagttttcctctccccgggccagaaagtagccaaaacgaaagagcgcccgcccaggtgaccgcagggcccggagtcccaggtgtcctggttcctaaccgggatgcagcctcttaccttggctgaggagcccagccagcctgagggagactgcaggagtcacgtcccgttgcggactcaagagttacccccatggtggctggagctcttttggagtgggcgtggagatggggaatgggaatgttgagcaacaatctcagccagcagccccagggtgagcagggtccccggtggtctagtctagtcccagaactcgcgtgttctgcagggggtatggctgacctggagcctggacttaccaccctcaggcaatactagcccctctggagcacggagctccttccccaaagacatgaagctattggagaactcgagctttgaagccatcaactcacagctgactgtggagactggagatgcccacatcattggcaggattgagagctactcatgtaagatggcaggagacgacaaacacatgttcaagcagttctgccaggagggccagccccacgtgctggaggcactttctccaccccagacttcaggactgagccccagc

SEQ ID NO: 16779 - DNA, 1098 bp, Homo sapiens
cccgacgtggcccaggcgggcgctgcctggtgactgcagcgccccagcggggccgagggaccgccctcctaggcgtctggagaaactaggcaatttttccgggtagagtggaggaacctgtagttttcctctccccgggccagaaagtagccaaaacgaaagagcgcccgcccaggcaatactagcccctctggagcacggagctccttccccaaagacatgaagctattggagaactcgagctttgaagccatcaactcacagctgactgtggagactggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcgggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctg

SEQ ID NO: 16780 - DNA, 4047 bp, Homo sapiens
agaaatcaaccttcttttagcgggcgtgtagcgccagcgcgctgtgacgtaatgtgaggggtctcccggcagggctgagctggaccaatgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacggtctcgctgtgtcacacaggctggagtgcagtggcgtgagctcggctgactgcaaactctgcctcccaggtttaagcgattctcctgtcacagcttcccaagtagctgggatttacaggtgtgcaccgccatgccaggctaatttttgtgtttttagtagagacagggtttcgccaagttgtccaggctggtcttgaactcctgggctcaagtgatccgcccgcctcagtctcccaaagtgcgaggatgacatgtgtgagctaccacaccagcaatgtctatgcttctcgatagctgtgaacatgaaaagacatctattgggagtccgaggcaggtggattgcttgaggccaggagttagagaccagcctggccaacaaggcaaaaccccgtctctactaaaaatatgaaaattagctgggcttggtggctcatgcctataatcctagctacttgggaggctgaggcacgagacttgcttaatacctgggaggcggagattgcagtgagccgagatcacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaatctaaa

SEQ ID NO: 16781 - DNA, 3016 bp, Homo sapiens
cattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaatct

SEQ ID NO: 16782 - DNA, 500 bp, Homo sapiens
ggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggagcttgaaatcgtcattggagatgaacacatttcttttacaacatcaaaaattggttcccttattgatgtcaatcaatccaaggatccagaaggcttacgagtattttattatcttgtccaggacctgaagtgtttggtcttcagtcttattggattacacttcaagattaaaccaatctagactgaatattggtgtggacatggggggtgggtgggagtagaaaattttgtgtatatcagggcagtatttttttatgaactataaatgattgtctttaataaatatgtgataaaatccaa

SEQ ID NO: 16783 - DNA, 756 bp, Homo sapiens
gccacttccgggcgaagaggttagcgagaaggaacccctccacgcagcgacgacgggacctgacgtcacttccgcgcgccgccgcaaacgtcagtgtcgggcgcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaattggttcccttattgatgtcaatcaatccaaggatccagaaggcttacgagtattttattatcttgtccaggacctgaagtgtttggtcttcagtcttattggattacacttcaagattaaaccaatctagactgaatattggtgtggacatggggggtgggtgggagtagaaaattttgtgtatatcagggcagtatttttttatgaactataaatgattgtctttaataaatatgtgataaaatccaatttttattattttataaagacctgaacatgtgaa

SEQ ID NO: 16784 - DNA, 3933 bp, Homo sapiens
tgggggctcgaggcgcctccgcggccgtggacgagcgtccgtgcggcctggtccgggccatgtccgcgtgaggaccccgccgctgtcgccgctcccgttccggccctggcccctctgcccggcagcgccgcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggtgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctctttttttttttttttgagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttttttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgaggtccgcctcctgggcgagacccagcagtggacagcatggtcctcacacccagctccctgcacacccaggccagccacccctcccgctcgtgcacaggcacgcagatgcgctcacacgtacacacacacaaatgcacgcccacttgcacatgctcacgcacatgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaata

SEQ ID NO: 16785 - DNA, 6470 bp, Homo sapiens
tgggggctcgaggcgcctccgcggccgtggacgagcgtccgtgcggcctggtccgggccatgtccgcgtgaggaccccgccgctgtcgccgctcccgttccggccctggcccctctgcccggcagcgccgcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaagccggtacgtgacctcccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcgtggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatcccccccaagaggcgccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctatgaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccgtgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatctggggacagcgcccggcggcgtcgtgcaggccacagtctgggcattggggctctgtgggaggctcctctctttgccttgcagtagccatccgggggctactctgagcacgggcttgttctcacccagggccgctccccacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggtgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctctttttttttttttttgagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttttttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgaggtccgcctcctgggcgagacccagcagtggacagcatggtcctcacacccagctccctgcacacccaggccagccacccctcccgctcgtgcacaggcacgcagatgcgctcacacgtacacacacacaaatgcacgcccacttgcacatgctcacgcacatgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaata

SEQ ID NO: 16786 - DNA, 6407 bp, Homo sapiens
tgggggctcgaggcgcctccgcggccgtggacgagcgtccgtgcggcctggtccgggccatgtccgcgtgaggaccccgccgctgtcgccgctcccgttccggccctggcccctctgcccggcagcgccgcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgcagtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaagccggtacgtgacctcccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcgtggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatcccccccaagaggcgccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctatgaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccgtgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatctggggacagcgcccggcggcgtcgtgcaggccacagtctgggcattggggctctgtgggaggctcctctctttgccttgcagtagccatccgggggctactctgagcacgggcttgttctcacccagggccgctccccacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggtgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctctttttttttttttttgagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttttttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgaggtccgcctcctgggcgagacccagcagtggacagcatggtcctcacacccagctccctgcacacccaggccagccacccctcccgctcgtgcacaggcacgcagatgcgctcacacgtacacacacacaaatgcacgcccacttgcacatgctcacgcacatgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaata

SEQ ID NO: 16787 - DNA, 1575 bp, Homo sapiens
tccgcggccgtggacgagcgtccgtgcggcctggtccgggccatgtccgcgtgaggaccccgccgctgtcgccgctcccgttccggccctggcccctctgcccggcagcgccgcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctcc

SEQ ID NO: 16788 - DNA, 2173 bp, Homo sapiens
gcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcagaaggatgaggaagttgtcttttgcttctcctcattccaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaacctttttttttacagagcctaattaataacttaatgactgtgtacatagcaatgtgtgtgtatgtatatgtctgtgagctattaatgttattaattttcataaaagctggaaagcagctgcctgtt

SEQ ID NO: 16789 - DNA, 2154 bp, Homo sapiens
gagggggcgtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaacctttttttttacagagcctaattaataacttaatgactgtgtacatagcaatgtgtgtgtatgtatatgtctgtgagctattaatgttattaattttcataaaagctggaaagcagctgcctgtt

SEQ ID NO: 16790 - DNA, 1514 bp, Homo sapiens
agagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaaggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcaga

SEQ ID NO: 16791 - DNA, 946 bp, Homo sapiens
gagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagag

SEQ ID NO: 16792 - DNA, 4608 bp, Homo sapiens
cttaatttcctgcaagatgaagttctgtgtttacatgttatgattttcattactaagccatcttttaaattttactttacagatcaacagtacaaattctgaagtttgtaaacttgctgatggtggtggtaagccatggcagatgataaagttgctatcttaacggatgatgaagaggaacagaagagaaagtatgtgcttgcagatccctttaatggtatttccagggaaccagaaccaccttcgaatgaaacaccttcctccacagaaacatctgctattcctgaggaggaaatagactggatagagaaacattgtgttaagataaacaacgatcttctaatttccaaggtcttttattttttcttttactctgcctatggctctctctatccccttttgcctgtgtattacaaacagctgggaatgtctccaagccagagtggactactagtaggtattcgttacttcattgaattctgcagtgcccccttttggggtgtagttgcagaccgctttaaaaaaggcaaaattgtcctcctcttttctcttttgtgttgggttttattcaacctgggcattggatttgtcaaacctgctaccttgagatgtgtaccaaagattcgcccaacaactcaccccaccaatgcaagtcaccagttaactatcctgccaacaaattcttcctttacctctttcctcaccatatcaccaaaaatgcgtgagaaaagaaaccttttggaaacaaggctcaatgtctcagacaccgttactttgccaacagctccaaacatgaacagtgaacccactctgcagccccagacaggtgaaattactaaccgtatgatggacttgactttgaactcaagcacagcaacccctgtctccccaggaagcgtaaccaaggagacaaccactgttattgttaccaccaccaaatctttaccttctgaccaagtcatgcttgtttatgatcaacaagaagttgaagctatattcttggtgatcttggtagttgtcataataggagaatttttcagtgcctcttctgtcacaatcgtagacacggtcacactccagtatctgggaaaacacagagatcgctatgggttgcagcgcatgtggggctccctgggctggggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggacttaatcaagctgctctgcagcgtgcagtatggctcagtgctgtttgtggcttggttcatgggttttggatatggcttcgtgttcacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttcttggagagaaccgtttaaaaaattacaagatatatttaaaaagtaaccagataaaagtagcacatgtgcttttgttaaaaataaagttaaaagttaaagttaaaaaatgaagttaaaagtttcatcagaaactttacatatctttagcaaatatatttttatatgtgtatggcatataatggaaataattctttgagcaacagaagctattattaactactgcaagctaagccgagcttaaaaatgccttttgttttaaatgggctttgagaaaaaaaacagaaacaagcgattatttcaaatcaaccaaccaactcagtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacatgcctttgttatggaacatttactgtgacagcagaatcgataatgcagtcatttccagccttgtgagctgacaccttcatgggtttgtggactttgtgactttttcttcctgtccccaaagtgccatatgctaccttaaaaaatattaaagtgaattcaaattacat

SEQ ID NO: 16793 - DNA, 4797 bp, Homo sapiens
gtcgcagccccggaggagcgcgcgagcagcccgggatggtgcgcgctgccccgacagccgccgccccggcgccccgagccgccgccccgtgctccggggacagggctccccgcgccccgcgcagctgagcgctgccgccgccgcagcagacaggatctctctcagttacccaggccggagtgcagtggcgtgatcctagctcactgcagccttgaacccctgggctcaagtgattctcctgccttggcctcctgaatagctagaactacagatcaacagtacaaattctgaagtttgtaaacttgctgatggtggtggtaagccatggcagatgataaagttgctatcttaacggatgatgaagaggaacagaagagaaagtatgtgcttgcagatccctttaatggtatttccagggaaccagaaccaccttcgaatgaaacaccttcctccacagaaacatctgctattcctgaggaggaaatagactggatagagaaacattgtgttaagataaacaacgatcttctaatttccaaggtcttttattttttcttttactctgcctatggctctctctatccccttttgcctgtgtattacaaacagctgggaatgtctccaagccagagtggactactagtaggtattcgttacttcattgaattctgcagtgcccccttttggggtgtagttgcagaccgctttaaaaaaggcaaaattgtcctcctcttttctcttttgtgttgggttttattcaacctgggcattggatttgtcaaacctgctaccttgagatgtgtaccaaagattcgcccaacaactcaccccaccaatgcaagtcaccagttaactatcctgccaacaaattcttcctttacctctttcctcaccatatcaccaaaaatgcgtgagaaaagaaaccttttggaaacaaggctcaatgtctcagacaccgttactttgccaacagctccaaacatgaacagtgaacccactctgcagccccagacaggtgaaattactaaccgtatgatggacttgactttgaactcaagcacagcaacccctgtctccccaggaagcgtaaccaaggagacaaccactgttattgttaccaccaccaaatctttaccttctgaccaagtcatgcttgtttatgatcaacaagaagttgaagctatattcttggtgatcttggtagttgtcataataggagaatttttcagtgcctcttctgtcacaatcgtagacacggtcacactccagtatctgggaaaacacagagatcgctatgggttgcagcgcatgtggggctccctgggctggggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggacttaatcaagctgctctgcagcgtgcagtatggctcagtgctgtttgtggcttggttcatgggttttggatatggcttcgtgttcacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttcttggagagaaccgtttaaaaaattacaagatatatttaaaaagtaaccagataaaagtagcacatgtgcttttgttaaaaataaagttaaaagttaaagttaaaaaatgaagttaaaagtttcatcagaaactttacatatctttagcaaatatatttttatatgtgtatggcatataatggaaataattctttgagcaacagaagctattattaactactgcaagctaagccgagcttaaaaatgccttttgttttaaatgggctttgagaaaaaaaacagaaacaagcgattatttcaaatcaaccaaccaactcagtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacatgcctttgttatggaacatttactgtgacagcagaatcgataatgcagtcatttccagccttgtgagctgacaccttcatgggtttgtggactttgtgactttttcttcctgtccccaaagtgccatatgctaccttaaaaaatattaaagtgaattcaaattacat

SEQ ID NO: 16794 - DNA, 517 bp, Homo sapiens
gtcgcagccccggaggagcgcgcgagcagcccgggatggtgcgcgctgccccgacagccgccgccccggcgccccgagccgccgccccgtgctccggggacagggctccccgcgccccgcgcagctgagcgctgccgccgccgcagcagacaggatctctctcagttacccaggccggagtgcagtggcgtgatcctagctcactgcagccttgaacccctgggctcaagtgattctcctgccttggcctcctgaatagctagaactacagatgatgaaatggaattggagccgctgagctggataggtgaaggcactaatgatgaaggaaaaatagatcaacagtacaaattctgaagtttgtaaacttgctgatggtggtggtaagccatggcagatgataaagttgctatcttaacggatgatgaagaggaacagaagagaaagtatgtgcttgcagatccctttaatggtatttccagggaaccagaaccaccttcgaatgaaacaccttcct

SEQ ID NO: 16795 - DNA, 546 bp, Homo sapiens
gtcgcagccccggaggagcgcgcgagcagcccgggatggtgcgcgctgccccgacagccgccgccccggcgccccgagccgccgccccgtgctccggggacagggctccccgcgccccgcgcagctgagcgctgccgccgccgcagcagatcaacagtacaaattctgaagtttgtaaacttgctgatggtggtggtaagccatggcagatgataaagttgctatcttaacggatgatgaagaggaacagaagagaaagtatgtgcttgcagatccctttaatggtatttccagggaaccagaaccaccttcgaatgaaacaccttcctccacagaaacatctgctattcctgaggaggaaatagactggatagagaaacattgtgttaagataaacaacgatcttctaatttccaaggtcttttattttttcttttactctgcctatggctctctctatccccttttgcctgtgtattacaaacagctgggaatgtctccaagccagagtggactactagtaggtattcgttacttcattgaatt

SEQ ID NO: 16796 - DNA, 551 bp, Homo sapiens
aatcttatctgatacagagtgctaaataaatcaacagtacaaattctgaagtttgtaaacttgctgatggtggtggtaagccatggcagatgataaagttgctatcttaacggatgatgaagaggaacagaagagaaagtatgtgcttgcagatccctttaatggtatttccagggaaccagaaccaccttcgaatgaaacaccttcctccacagaaacatctgctattcctgaggaggaaatagactggatagagaaacattgtgttaagataaacaacgatcttctaatttccaaggtcttttattttttcttttactctgcctatggctctctctatccccttttgcctgtgtattacaaacagctgggaatgtctccaagccagagtggactactagtaggtattcgttacttcattgaattctgcagtgcccccttttggggtgtagttgcagaccgctttaaaaaaggcaaaattgtcctcctcttttctcttttgtgttgggttttattcaacctgggcattggatttgtcaaacctgctacct

SEQ ID NO: 16797 - DNA, 1431 bp, Homo sapiens
gaaaaggctgagggcagatatgttagaagccatcttcttattcctaaattcatgcttaaatgtaattgtccttcagttttcccactcctgagtttggagtctgctggatgatgggtggtttggggaaggaaaagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttctt

SEQ ID NO: 16798 - DNA, 1388 bp, Homo sapiens
acttttatattaacaagcattttgaaaaggctgagggcagatatgttagaagccatcttcttattcctaaattcatgcttaaatgtaattgtccttcagttttcccactcctgagtttggagtctgctggatgatgggtggtttggggaaggaaaagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttctt

SEQ ID NO: 16799 - DNA, 4510 bp, Homo sapiens
aggttacaagcagcagatcccaccttcagtcctggctctgacaagccctccagcttcacgccacccgggatgggagaaagcaggtgtcgcgagagttgggcgcaagacgccttgtagggagtgtaactatggccggcctgcggaacgaaagtgaacaggagccgctcttaggcgacacacctggaagcagagaatgggacattttagagactgaagagcattataagagccgatggagatctattaggattttatatcttactatgtttctcagcagtgtagggttttctgtagtgatgatgtccatatggccatatctccaaaagattgatccgacagctgatacaagttttttgggctgggttattgcttcatatagtcttggccaaatggtagcttcacctatatttggtttatggtctaattatagaccaagaaaagagcctcttattgtctccatcttgatttccgtggcagccaactgcctctatgcatatctccacatcccagcttctcataataaatactacatgctggttgctcgtggattgttgggaattggagcaggaaatgtagcagttgttagatcatatactgctggtgctacttcccttcaggaaagaacaagttccatggcaaacataagcatgtgtcaagcattaggttttattctaggtccagtttttcagacttgttttacattccttggagaaaaaggtgtgacatgggatgtgattaaactgcagataaacatgtatacaacaccagttttacttagcgccttcctgggaattttaaatattattctgatccttgccatactaagagaacatcgtgtggatgactcaggaagacagtgtaaaagtattaattttgaagaagcaagtacagatgaagctcaggttccccaaggaaatattgaccaggttgctgttgtggccatcaatgttctgttttttgtgactctatttatctttgccctttttgaaaccatcattactccattaacaatggatatgtatgcctggactcaagaacaagctgtgttatataatggcataatacttgctgctcttggggttgaagccgttgttattttcttaggagttaagttgctttccaaaaagattggcgagcgtgctattctactgggaggactcatcgttgtatgggttggcttctttatcttgttaccttggggaaatcaatttcccaaaatacagtgggaagatttgcacaataattcaatccctaataccacatttggggaaattattattggtctttggaagtctccaatggaagatgacaatgaaagaccaactggttgctcgattgaacaagcctggtgcctctacaccccggtgattcatctggcccagttccttacatcagctgtgctaataggattaggctatccagtctgcaatcttatgtcctatactctatattcaaaaattctaggaccaaaacctcagggtgtatacatgggctggttaacagcatctggaagtggagcccggattcttgggcctatgttcatcagccaagtgtatgctcactggggaccacgatgggcattcagcctggtgtgtggaataatagtgctcaccatcaccctcctgggagtggtttacaaaagactcattgctctttctgtaagatatgggaggattcaggaataaactagctaagactgtgatggaaactacttgctgtgtggcacttcctggtctaaagctctgctagacaattgcggtgagccagtctccaagaatcagactacagatattgcagattttgaagaacaagaacatatgttgaataacagagagaattctacatgtcattgtgaatagtaggttatataaaaacatactagatgataatttccttacctcagaaatgaaatattattcttataatacctttttgtggttgcatgaactaatgagtgaatggacaatgatgaataaatgtgaagctgtattcttaatacccactgcagaagtgtcattaaaataatatacagtggaaccagaaagagggttctgtaagaattagccatagcagaacaaaattatagaattttaaatacctctacccaagtagaggtatttttattcagacacctactttttatttataaaaaaatgcattttctattatcaagttcacttatgaaataaaaattataacacatattttccatttagcgtgcctaacatcctaccttgccttctatgagtctttcttctaatactacacctctgccttattttagttcagggtttcactaagtaacccctacattaataaatgagtatggataatgctaatatttgagcaatacagaggattaagagatcaagatacttcactgcctattagcctaatagggatacctactttctttcaaatgccaaaaattcacattagaaacataatccagatatgtgttattttatatatatatatacaaaacagtaaatggtttcttaaaattattgctatttttcaacccccttaaactggagaaaaacatttaattagtaaaacattaattaatttactttaatttttcccatctctcagtagtggcggggaggaacacaacagttttcaatctatgtctgcatagttgtgtagagctgcagaattttagttggatttttaatttggatgatccctgacagccccaaactagtcaggctaataagtatttgaggcaaaatggctttaatctaacaatttactgagtttacctgaagttggctaaataacactgtatgtttaacttctacctctacataagttgaatgctgataaaaggaactagtagataactatgtatattgataagcactgttaagaaaatgcaaaaatatttctaaacacttttccaaatgttttctactttaagttagaaatagtttcaaatctgagaataaacactatataatctgcactttataggttgggtgcagtgtctcatgcctgtaatcccagcactttggaaggccaaggcaggaggattgcttgaggccaggaattcaagaccagcctgggaaacaaagtgagaccctgtctttacaaaaaataaaaacaaaaatttaaaactgtataatctgcactttatgctaaactagctgtgctcttaaactcaattttttcagctctaataaagggcttaatttgatagaattattctacgattaaattttgaagactgttttcactctcctctgccgcccatagcaagactgcttccatagatttctcagaaccgtagccagttctggctatttggtcaagtctgggatccctcttacctgctattctgcagctgctttctctgtcttacattttttgggccacgtctaatcttaaagagtaaactctacccttggtttgcatagtgtgcatgacaaaaataacaagaataatggtaatgatgaaaatgataagagcaaaatttgtggagtgctttccacattccaggtaatgtgtaacatacaatttaattcttacagcagtcttatggagtgaaaatactattatgattcccgttttacagatgaaagaatggaggcacagaaaagttacttgtctaagtaacagtctatccttaaagtccacagtcttaaccacttgatttttcatagtgaggaaaatatcccagaaagttgcagtttcaattaatcactaattgtagggtaatttaactataccagtgagtcctactagcagaaatatttgggcaacataagcccactgactggagcttttgtcttagcataataacctgtttccagcaagaatataacagaaaaaagtttcccagctttcaaaggtttataatattgattaaaatttagataaacttaaccttacacaaatgactcttactttcctttttattgagagcattttctttggagcattttcttctttggaggattataccttgctcatcttggcacaaaagaaggcgaaaggaagtaacatgggattgggaaaagagcaaggagataaagtttgaggaaaaaaaatcaccatgttgatgtcttcttgagtaggccaagttgcgtataaagagaaaatgacaacaggagattttaaggtatgatatattgttaagagtagtacatatttaagaagagaaaatatgtttttgaaaacaaatttaaacttgaaaggatgattttcatattttgaagggatttataacttcacaaagcatctccattctatcttgttcagctttacatttaaaaataaactcttcttgttcatataaaccttatctcttacataaagtgaaatctgttaattttttgttttgacaaggataaactacttacctgcatctgtttaagaatagattaacttattttgagaagaaattctgggcaccatttttgaccattgaagacttatttgtaatttaatttctactttacattgtgaatgttcattttctaataaacaagattattttgcatatgta

SEQ ID NO: 16800 - DNA, 910 bp, Homo sapiens
agcagatcccaccttcagtcctggctctgacaagccctccagagaatgggacattttagagactgaagagcattataagagccgatggagatctattaggattttatatcttactatgtttctcagcagtgtagggttttctgtagtgatgatgtccatatggccatatctccaaaagattgatccgacagctgatacaagttttttgggctgggttattgcttcatatagtcttggccaaatggtagcttcacctatatttggtttatggtctaattatagaccaagaaaagagcctcttattgtctccatcttgatttccgtggcagccaactgcctctatgcatatctccacatcccagcttctcataataaatactacatgctggttgctcgtggattgttgggaattggagcagtttttcagacttgttttacattccttggagaaaaaggtgtgacatgggatgtgattaaactgcagataaacatgtatacaacaccagttttacttagcgccttcctgggaattttaaatattattctgatccttgccatactaagcaagtacagatgaagctcaggttccccaaggaaatattgaccaggttgctgttgtggccatcaatgttctgttttttgtgactctatttatctttgccctttttgaaaccatcattactccattaacaatggatatgtatgcctggactcaagaacaagctgtgttatataatggcataatacttgctgctcttggggttgaagccgttgttattttcttaggagttaagttgctttccaaaaagattggcgagcgtgctattctactgggaggactcatcgttgtatgggttggcttctttatcttgttaccttggggaaatcaatttcccaaaatacagtggga

SEQ ID NO: 16801 - DNA, 816 bp, Homo sapiens
acaagcagcagatcccaccttcagtcctggctctgacaagccctccagagaatgggacattttagagactgaagagcattataagagccgatggagatctattaggattttatatcttactatgtttctcagcagtgtagggttttctgtagtgatgatgtccatatggccatatctccaaaagattgatccgacagctgatacaagttttttgggctgggttattgcttcatatagtcttggccaaatggtagcttcacctatatttggtttatggtctaattatagaccaagaaaagagcctcttattgtctccatcttgatttccgtggcagccaactgcctctatgcatatctccacatcccagcttctcataataaatactacatgctggttgctcgtggattgttgggaattggagcaggaaatgtagcagttgttagatcatatactgctggtgctacttcccttcaggaaagaacaagttccatggcaaacataagcatgtgtcaagcattaggttttattctaggtccagagaacatcgtgtggatgactcaggaagacagtgtaaaagtattaattttgaagaagcaagtacagatgaagctcaggttccccaaggaaatattgaccaggttgctgttgtggccatcaatgttctgttttttgtgactctatttatctttgccctttttgaaaccatcattactccattaacaatggatatgtatgcctggactcaagaacaagctgtgttatataatggcataatacttgctgctcttggggttgaagccgttgttattttctta

SEQ ID NO: 16802 - DNA, 2043 bp, Homo sapiens
ggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatgacacaacgcttccctacattctatttgtcaatgatgatttgcaactagttggagattctcagagcaggaaggaatcttttcaaccagagcaggaactgtcttctgcaatgccttggacttgagcctccagcctccacttgaacaccatgtgaagggaacctcagtacttcataaaatggcctttctcattcatctttcatgggaacatttattgtacaagcgctttgaatatcatgggcaccatgactgtgaccctacaggtaggattggatcactccatgagagtagccggcaggtttctacaatggcctgggaatggactgattatttttatacattttctggcctgagagaaagccaaagtcccctgctgttcacagcaaccctgcctgggagcttggaatcttggtaatctgcccggttggatctatggaggtagtctcaccctttttgtcttttgtgggaaattaagagaaataattatcagacatatcatcacctccagtggaactacagagacctggacccagctgcactattttaatgtaaaaataacagtatggccaggtgcagtggctcacgcctgtaatcccatcactttgagcagccaaggcgggcggatcacgaggtcaggagattaagaccatcctggccaatatggtgaaaccctgtctctactaaaatacaaaaaattagctgggcatggtgttgcgtgcctgtagtcccagctacttgggaggctgagacaggggaattgcttgaacccgggaggcagagattgcagtgagccgagatcacgccactgcactccagcctggcgacagagtgagactctatctcaaaataataataataataataataataataataataataataacagtatatttggtgtcaggagagggctcaattctcatttctgcctttcctgtgctggctcatggtagctgggcatgacttgccttcctacataggttgtcttcatacatatgcactgggaatcaataaaagcccatggtgagaatgaa

SEQ ID NO: 16803 - DNA, 1704 bp, Homo sapiens
acgcgtagcattcctgccgtccctggaaaagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcagagcggggagactctgagtcattcttactggaagtctaggaccaggtcacatgtgaatactatttcttgaaggtgtggtttcaacctctgttgccgatgtggttactaaaggttctgatcccacttgaacggaaaggtctgaggatattgattcagtcctgggtttttccctaactacaggatagggtggggtagagaaaggatatttgggggaaattttacttggatgaagattttcttggatgtagtttgaagactgcagtgtttgaagtctctgagggaagagatttggtctgtctggatcaagatttcaggcagattaggattccattcacagcccctgagcttccttcccaaggctgtattgtaattatagcaatatttcatggaggatttttctacatgataaactaagagccaagaaataaaatttttaaaatgccctaa

SEQ ID NO: 16804 - DNA, 1704 bp, Homo sapiens
acgcgtagcattcctgccgtccctggaaaagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagagcccctcactgtcaccttcccgagaataccctaagaccaataaatacttcagtatttcagagcggggagactctgagtcattcttactggaagtctaggaccaggtcacatgtgaatactatttcttgaaggtgtggtttcaacctctgttgccgatgtggttactaaaggttctgatcccacttgaacggaaaggtctgaggatattgattcagtcctgggtttttccctaactacaggatagggtggggtagagaaaggatatttgggggaaattttacttggatgaagattttcttggatgtagtttgaagactgcagtgtttgaagtctctgagggaagagatttggtctgtctggatcaagatttcaggcagattaggattccattcacagcccctgagcttccttcccaaggctgtattgtaattatagcaatatttcatggaggatttttctacatgataaactaagagccaagaaataaattttttaaaatgccctaa

SEQ ID NO: 16805 - DNA, 305 bp, Homo sapiens
gtcgaagcgcacgaactcctcccggttgtagatgtatctctccaggaagcgctgtgtcccattaaacgcgtagcattcctgccgtccctggaaaaggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctg

SEQ ID NO: 16806 - DNA, 1375 bp, Homo sapiens
caacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgggaatgtaaagaggaggccctaggatttgtagaatgtaaggaagggaggaaaaattcaatctgataagtgttcattgatcttctaatgggttaaaagcattcagccacataacaacaacaacaccgataactaactgagtagttaatatggtcaggcgctattctgaggatttacatttattaactcactttattctcacacatagtctttgaggtaggtactattattttcactatttcacatgagagatacttacatctttttacatacacagagactttaagcactttgatcaagttcccacagctatgaagtagtagggctagcttccaatccagaaagtctggatccaagactgtttatccactgtcctattcaccctattttgtgaaggaaaagaccaagttcaaattctccagagtccattgccaaataatggagtcagatctatatttctatacataattacaacacagtgtggtgggtgcctgtaactacttactgtctctacttggactcattccatggcaatgttcacacaaaaaatgcccctccagagatcttacaggtttctatttatcataacactcaccatgctttatatttttatatgttttgggaattctcttagcattagacagtgaacttccatgcagatgaccacatctaattcattattattattgttattcatgctggacctcaggtacaaaaggttaagaacttctcagttcattatatgatcatcattggtgcctccgagctctctctctctcccttgatttatttggtcccttttatctccagtccttactcccatatctaacctcttacccctacctcataggtaaacattttaatgaatttgatgtttccttttatttgcatagatcctctgtaatatgtagtagtgtccagtgtacatgtatttttaattaaccaaaatggcattaaattatagatctaattttgta

SEQ ID NO: 16807 - DNA, 918 bp, Homo sapiens
gcacgaactcctcccggttgtagatgtatctctccaggaagcgctgtgtcccattaaacgcgtagcattcctgccgtccctggaaaagcaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactggg

SEQ ID NO: 16808 - DNA, 1626 bp, Homo sapiens
gttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcagagcggggagactctgagtcattcttactggaagtctaggaccaggtcacatgtgaatactatttcttgaaggtgtggtttcaacctctgttgccgatgtggttactaaaggttctgatcccacttgaacggaaaggtctgaggatattgattcagtcctgggtttttccctaactacaggatagggtggggtagagaaaggatatttgggggaaattttacttggatgaagattttcttggatgtagtttgaagactgcagtgtttgaagtctctgagggaagagatttggtctgtctggatcaagatttcaggcagattaggattccattcacagcccctgagcttccttcccaaggctgtattgtaattatagcaatatttcatggaggatttttctacatgataaactaagagccaagaaataaaatttttaaaatgccctaa

SEQ ID NO: 16809 - DNA, 305 bp, Homo sapiens
gtcgaagcgcgcgaactcctcccggttgtagatgtatctctccaggaagcgctgtgtcccattaaacgcgtagcattcctgccgtccctggaaaaggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctg

SEQ ID NO: 16810 - DNA, 1704 bp, Homo sapiens; identical to SEQ ID NO: 16803

SEQ ID NO: 16811 - DNA, 1375 bp, Homo sapiens
caacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgggaatgtaaagaggaggccctaggatttgtagaatgtaaggaagggaggaaaaattcaatctgataagtgttcattgatcttctaatgggttaaaagcattcagccacataacaacaacaacaccgataactaactgagtagttaatatggtcaggcgctattctgaggatttacatttattaactcactttattctcacacatagtctttgaggtaggtactattattttcactatttcacatgagagatacttacatctttttacatacacagagactttaagcactttgatcaagttcccacagctatgaagtagtagggctagcttccaatccagaaagtctggatccaagactgtttatccactgtcctattcaccctattttgtgaaggaaaagaccaagttcaaattctccagagtccattgccaaataatggagtcagatctatatttctatacataattacaacacagtgtggtgggtgcctgtaactacttactgtctctacttggactcattccatggcaatgttcacacaaaaaatgcctctccagagatcttacaggtttctatttatcataacactcaccatgctttatatttttatatgttttgggaattctcttagcattagacagtgaacttccatgcagatgaccacatctaattcattattattattgttattcatgctggacctcaggtacaaaaggttaagaacttctcagttcattatatgatcatcattggtgcctccgagctctctctctctcccttgatttatttggtcccttttatctccagtccttactcccatatctaacctcttacccctacctcataggtaaacattttaatgaatttgatgtttccttttatttgcatagatcctctgtaatatgtagtagtgtccagtgtacatgtatttttaattaaccaaaatggcattaaattatagatctaattttgta

SEQ ID NO: 16812 - DNA, 1704 bp, Homo sapiens; identical to SEQ ID NO: 16804

SEQ ID NO: 16813 - DNA, 305 bp, Homo sapiens; identical to SEQ ID NO: 16809

SEQ ID NO: 16814 - DNA, 918 bp, Homo sapiens
gcacgaactcctcccggttgtagatgtatctctccaggaagcgctgtgtcccattaaacgcgtagcattcctgccgtaactggtacaccaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactggg

SEQ ID NO: 16815 - DNA, 305 bp, Homo sapiens; identical to SEQ ID NO: 16805

SEQ ID NO: 16816 - DNA, 1375 bp, Homo sapiens; identical to SEQ ID NO: 16806

SEQ ID NO: 16817 - DNA, 1157 bp, Homo sapiens
gctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttc

SEQ ID NO: 16818 - DNA, 1375 bp, Homo sapiens; identical to SEQ ID NO: 16811

SEQ ID NO: 16819 - DNA, 305 bp, Homo sapiens; identical to SEQ ID NO: 16805

SEQ ID NO: 16820 - DNA, 918 bp, Homo sapiens
gcgcgaactcctcccggttgtagatgtatctctccaggaagcgctgtgtcccattaaacgcgtagcattcctgccgtccctggaaaagcaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactggg

SEQ ID NO: 16821 - DNA, 703 bp, Homo sapiens
ctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcata

SEQ ID NO: 16822 - DNA, 703 bp, Homo sapiens; identical to SEQ ID NO: 16821

SEQ ID NO: 16823 - DNA, 1375 bp, Homo sapiens; identical to SEQ ID NO: 16806

SEQ ID NO: 16824 - DNA, 703 bp, Homo sapiens; identical to SEQ ID NO: 16821

SEQ ID NO: 16825 - DNA, 918 bp, Homo sapiens; identical to SEQ ID NO: 16807

SEQ ID NO: 16826 - DNA, 305 bp, Homo sapiens
gtcgaagcgcacgagctcctcccggttgtagatgtatctctccaggaagcgctgtgtcccattaaacgcgtagcattcctgccgtccctggaaaaggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctg

SEQ ID NO: 16827 - DNA, 703 bp, Homo sapiens; identical to SEQ ID NO: 16821

SEQ ID NO: 16828 - DNA, 918 bp, Homo sapiens
gcacgagctcctcccggttgtagatgtatctctccaggaagcgctgtgtcccattaaacgcgtagcattcctgccgtccctggaaaagcaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactggg

SEQ ID NO: 16829 - DNA, 1375 bp, Homo sapiens; identical to SEQ ID NO: 16806

SEQ ID NO: 16830 - DNA, 1704 bp, Homo sapiens; identical to SEQ ID NO: 16803

SEQ ID NO: 16831 - DNA, 703 bp, Homo sapiens; identical to SEQ ID NO: 16821

SEQ ID NO: 16832 - DNA, 305 bp, Homo sapiens; identical to SEQ ID NO: 16809

SEQ ID NO: 16833 - DNA, 703 bp, Homo sapiens; identical to SEQ ID NO: 16821

SEQ ID NO: 16834 - DNA, 305 bp, Homo sapiens
gtcgaagcgcacgaactcctcccggttgtagatgtatctctccaggaagcgctgtgtcccattaaacgcgtagcattcctgccgtaactggtacacgtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctg

SEQ ID NO: 16835 - DNA, 703 bp, Homo sapiens; identical to SEQ ID NO: 16821

SEQ ID NO: 16836 - DNA, 1375 bp, Homo sapiens
caacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgggaatgtaaagaggaggccctaggatttgtagaatgtaaggaagggaggaaaaattcaatctgataagtgttcattgatcttctaatgggttaaaagcattcagccacataacaacaacaataccgataactaactgagtagttaatatggtcaggcgctattctgaggatttacatttattaactcactttattctcacacatagtctttgaggtaggtactattattttcactatttcacatgagagatacttacatctttttacatacacagagactttaagcactttgatcaagttcccacagctatgaagtagtagggctagcttccaatccagaaagtctggatccaagactgtttatccactgtcctattcaccctattttgtgaaggaaaagaccaagttcaaattctccagagtccattgccaaataatggagtcagatctatatttctatacataattacaacacagtgtggtgggtgcctgtaactacttactgtctctacttggactcattccatggcaatgttcacacaaaaaatgcccctccagagatcttacaggtttctatttatcataacactcaccatgctttatatttttatatgttttgggaattctcttagcattagacagtgaacttccatgcagatgaccacatctaattcattattattattgttattcatgctggacctcaggtacaaaaggttaagaacttctcagttcattatatgatcatcattggtgcctccgagctctctctctctcccttgatttatttggtcccttttatctccagtccttactcccatatctaacctcttacccctacctcataggtaaacattttaatgaatttgatgtttccttttatttgcatagatcctctgtaatatgtagtagtgtccagtgtacatgtatttttaattaaccaaaatggcattaaattatagatctaattttgta

SEQ ID NO: 16837 - DNA, 918 bp, Homo sapiens; identical to SEQ ID NO: 16820

SEQ ID NO: 16838 - DNA, 1704 bp, Homo sapiens; identical to SEQ ID NO: 16803

SEQ ID NO: 16839 - DNA, 1375 bp, Homo sapiens; identical to SEQ ID NO: 16806

SEQ ID NO: 16840 - DNA, 918 bp, Homo sapiens; identical to SEQ ID NO: 16807

SEQ ID NO: 16841 - DNA, 918 bp, Homo sapiens; identical to SEQ ID NO: 16820

SEQ ID NO: 16842 - DNA, 1704 bp, Homo sapiens; identical to SEQ ID NO: 16803

SEQ ID NO: 16843 - DNA, 703 bp, Homo sapiens; identical to SEQ ID NO: 16821

SEQ ID NO: 16844 - DNA, 1157 bp, Homo sapiens; identical to SEQ ID NO: 16817

SEQ ID NO: 16845 - DNA, 1157 bp, Homo sapiens; identical to SEQ ID NO: 16817

SEQ ID NO: 16846 - DNA, 1157 bp, Homo sapiens
gctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagagcccctcactgtcaccttcccgagaataccctaagaccaataaatacttcagtatttc

SEQ ID NO: 16847 - DNA, 1157 bp, Homo sapiens; identical to SEQ ID NO: 16817

SEQ ID NO: 16848 - DNA, 1157 bp, Homo sapiens; identical to SEQ ID NO: 16846

SEQ ID NO: 16849 - DNA, 1157 bp, Homo sapiens; identical to SEQ ID NO: 16817

SEQ ID NO: 16850 - DNA, 1560 bp, Homo sapiens
gtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgttttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccgtattcccacagcactaattcaacatatatcttactgagagcatgttttatcattaccattaagaagttaaatgaacatcagaatttaaaatcataaatataatctaatacactttaa

SEQ ID NO: 16851 - DNA, 1424 bp, Homo sapiens
gagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggaggagcgggcagtgccggacaggatgtgcagacacaactacgagctgggcgggcccatgaccctgcagcgccgaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 16852 - DNA, 1560 bp, Homo sapiens
gtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggaggagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 16853 - DNA, 688 bp, Homo sapiens
aaacaggcctggagaggctctgcgacccgcttaggaccacagaactcgggacggcaggaatgctacgcgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggaggagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaag

SEQ ID NO: 16854 - DNA, 1424 bp, Homo sapiens
gagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 16855 - DNA, 1424 bp, Homo sapiens
gagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcatggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 16856 - DNA, 1361 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcatggatagtcctgtcaccgtggagtggaaggcacagtctgattctgcccggagtaagacattgacgggagctgggggcttcgtgctggggctcatcatctgtggagtgggcatcttcatgcacaggaggagcaagaaaggtgagaaagcctgcaggttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 16857 - DNA, 1560 bp, Homo sapiens
gtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcatggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 16858 - DNA, 1424 bp, Homo sapiens; identical to SEQ ID NO: 16854

SEQ ID NO: 16859 - DNA, 688 bp, Homo sapiens
aaacaggcctggagaggctctgcgacccgcttaggaccacagaactcgggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaag

SEQ ID NO: 16860 - DNA, 1560 bp, Homo sapiens
gtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 16861 - DNA, 1361 bp, Homo sapiens
agaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaaggtgagaaagcctgcaggttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 16862 - DNA, 688 bp, Homo sapiens
aaacaggcctggagaggctctgcgacccgcttaggaccacagaactcgggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaag

SEQ ID NO: 16863 - DNA, 1560 bp, Homo sapiens
gtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 16864 - DNA, 1499 bp, Homo sapiens
agcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggccgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacacttt

SEQ ID NO: 16865 - DNA, 1560 bp, Homo sapiens; identical to SEQ ID NO: 16857

SEQ ID NO: 16866 - DNA, 688 bp, Homo sapiens; identical to SEQ ID NO: 16862

SEQ ID NO: 16867 - DNA, 1361 bp, Homo sapiens
agaattaccttttccagggacggcaggaatgctacgcgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggaggagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaaggtgagaaagcctgcaggttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 16868 - DNA, 1560 bp, Homo sapiens; identical to SEQ ID NO: 16863

SEQ ID NO: 16869 - DNA, 1361 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaaggtgagaaagcctgcaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgttttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccgtattcccacagcactaattcaacatatatcttactgagagcatgttttatcattaccattaagaagttaaatgaacatcagaatttaaaatcataaatataatctaatacactttaa

SEQ ID NO: 16870 - DNA, 688 bp, Homo sapiens
aaacaggcctggagaggctctgcgacccgcttaggaccacagaactcgggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcatggatagtcctgtcaccgtggagtggaaggcacagtctgattctgcccggagtaagacattgacgggagctgggggcttcgtgctggggctcatcatctgtggagtgggcatcttcatgcacaggaggagcaagaaag

SEQ ID NO: 16871 - DNA, 1424 bp, Homo sapiens
gagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcagcgccgaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgttttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccgtattcccacagcactaattcaacatatatcttactgagagcatgttttatcattaccattaagaagttaaatgaacatcagaatttaaaatcataaatataatctaatacactttaa

SEQ ID NO: 16872 - DNA, 1424 bp, Homo sapiens; identical to SEQ ID NO: 16855

SEQ ID NO: 16873 - DNA, 1424 bp, Homo sapiens; identical to SEQ ID NO: 16854

SEQ ID NO: 16874 - DNA, 688 bp, Homo sapiens; identical to SEQ ID NO: 16870

SEQ ID NO: 16875 - DNA, 1361 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaaggtgagaaagcctgcaggttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 16876 - DNA, 1361 bp, Homo sapiens; identical to SEQ ID NO: 16861

SEQ ID NO: 16877 - DNA, 1424 bp, Homo sapiens
gagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctgggcgggcccatgaccctgcagcgccgaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 16878 - DNA, 688 bp, Homo sapiens
aaacaggcctggagaggctctgcgacccgcttaggaccacagaactcgttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaag

SEQ ID NO: 16879 - DNA, 1560 bp, Homo sapiens; identical to SEQ ID NO: 16863

SEQ ID NO: 16880 - DNA, 1361 bp, Homo sapiens; identical to SEQ ID NO: 16856

SEQ ID NO: 16881 - DNA, 688 bp, Homo sapiens; identical to SEQ ID NO: 16862

SEQ ID NO: 16882 - DNA, 1361 bp, Homo sapiens; identical to SEQ ID NO: 16861

SEQ ID NO: 16883 - DNA, 940 bp, Homo sapiens
aaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgaggtgagtgagggctttgggccggcggtcccagggcagccccgcgggcccgtgcccagggcgcaggagcagccgggttggcctaagggaccttagtgccgggcggaaaggggactttgggttggggattcatggggggagcccatctggagcttgtcaggggagcgagcgcggggacctggactgggctgagcatggagtgaggaggacgagagcagagagacccccgggacttcatcaggcctggcagctgactgcatgtggggtgaaaaaaggaagccacaggacagcgcacaagggtatggtgtggagatggaggtggagatggcacagcaggccacacagagaagaaacctacagggagaaagaggaaaaaaatgaagggaggaggaggaggaagctggggagatcacacctttgattttcttgttcctggaaagtgaaaggaagttcacctgctatgagtgagaaggtggacacactgggtggggatgaggtgagtg

SEQ ID NO: 16884 - DNA, 1499 bp, Homo sapiens
agcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggccgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacacttt

SEQ ID NO: 16885 - DNA, 1499 bp, Homo sapiens; identical to SEQ ID NO: 16864

SEQ ID NO: 16886 - DNA, 940 bp, Homo sapiens
aaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggaggagcgggcagtgccggacaggatgtgcagacacaactacgagctgggcgggcccatgaccctgcagcgccgaggtgagtgagggctttgggccggcggtcccagggcagccccgcgggcccgtgcccagggcgcaggagcagccgggttggcctaagggaccttagtgccgggcggaaaggggactttgggttggggattcatggggggagcccatctggagcttgtcaggggagcgagcgcggggacctggactgggctgagcatggagtgaggaggacgagagcagagagacccccgggacttcatcaggcctggcagctgactgcatgtggggtgaaaaaaggaagccacaggacagcgcacaagggtatggtgtggagatggaggtggagatggcacagcaggccacacagagaagaaacctacagggagaaagaggaaaaaaatgaagggaggaggaggaggaagctggggagatcacacctttgattttcttgttcctggaaagtgaaaggaagttcacctgctatgagtgagaaggtggacacactgggtggggatgaggtgagtg

SEQ ID NO: 16887 - DNA, 940 bp, Homo sapiens
aaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgaggtgagtgagggctttgggccggcggtcccagggcagccccgcgggcccgtgcccagggcgcaggagcagccgggttggcctaagggaccttagtgccgggcggaaaggggactttgggttggggattcatggggggagcccatctggagcttgtcaggggagcgagcgcggggacctggactgggctgagcatggagtgaggaggacgagagcagagagacccccgggacttcatcaggcctggcagctgactgcatgtggggtgaaaaaaggaagccacaggacagcgcacaagggtatggtgtggagatggaggtggagatggcacagcaggccacacagagaagaaacctacagggagaaagaggaaaaaaatgaagggaggaggaggaggaagctggggagatcacacctttgattttcttgttcctggaaagtgaaaggaagttcacctgctatgagtgagaaggtggacacactgggtggggatgaggtgagtg

SEQ ID NO: 16888 - DNA, 940 bp, Homo sapiens
aaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctgggcgggcccatgaccctgcagcgccgaggtgagtgagggctttgggccggcggtcccagggcagccccgcgggcccgtgcccagggcgcaggagcagccgggttggcctaagggaccttagtgccgggcggaaaggggactttgggttggggattcatggggggagcccatctggagcttgtcaggggagcgagcgcggggacctggactgggctgagcatggagtgaggaggacgagagcagagagacccccgggacttcatcaggcctggcagctgactgcatgtggggtgaaaaaaggaagccacaggacagcgcacaagggtatggtgtggagatggaggtggagatggcacagcaggccacacagagaagaaacctacagggagaaagaggaaaaaaatgaagggaggaggaggaggaagctggggagatcacacctttgattttcttgttcctggaaagtgaaaggaagttcacctgctatgagtgagaaggtggacacactgggtggggatgaggtgagtg

SEQ ID NO: 16889 - DNA, 1510 bp, Homo sapiens
cttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaaggtgagaaagcctgcaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgttttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccgtattcccacagcactaattcaacatatatcttactgagagcatgttttatcattaccattaagaagttaaatgaacatcagaatttaaaatcataaatataatctaatacacttt

SEQ ID NO: 16890 - DNA, 1499 bp, Homo sapiens
agcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggaggagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggccgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacacttt

SEQ ID NO: 16891 - DNA, 940 bp, Homo sapiens; identical to SEQ ID NO: 16883

SEQ ID NO: 16892 - DNA, 940 bp, Homo sapiens; identical to SEQ ID NO: 16883

SEQ ID NO: 16893 - DNA, 908 bp, Homo sapiens
aattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcatggatagtcctgtcaccgtggagtggaaggcacagtctgattctgcccggagtaagacattgacgggagctgggggccgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaa

SEQ ID NO: 16894 - DNA, 1400 bp, Homo sapiens
aatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcagcgccgagaaagaggaaaaaaatgaagggaggaggaggaggaagctggggagatcacacctttgattttcttgttcctggaaagtgaaaggaagttcacctgctatgagtgagaaggtggacacactgggtggggatgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgttttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgt

SEQ ID NO: 16895 - DNA, 1491 bp, Homo sapiens
cttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggccgtgctggggctcatcatctgtggagtgggcatcttcatgcacaggaggagcaagaaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgttttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccgtattcccacagcactaattcaacatatatcttactgagagcatgttttatcattaccattaagaagttaaatgaacatcagaatttaaaatcataaatataatctaatacacttt

SEQ ID NO: 16896 - DNA, 1499 bp, Homo sapiens; identical to SEQ ID NO: 16864

SEQ ID NO: 16897 - DNA, 940 bp, Homo sapiens; identical to SEQ ID NO: 16887

SEQ ID NO: 16898 - DNA, 908 bp, Homo sapiens; identical to SEQ ID NO: 16893

SEQ ID NO: 16899 - DNA, 1591 bp, Homo sapiens
ggcagggtttggtttgggtgtcttcagatttccttgtcttgaggtcctcacaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtgaatcccatcctggaagggaaggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaaagacatgcctggggtaagccacccggctacctaattcctcagtaacctccatctaaaatctccaaggaagcaataaattccttttatgagatctatgtcaaatttttccatctttcatccagggctgactgaaactatggctaataattggggtactcttatgtttcaatccaatttaacctcatttcccagatcatttttcatgtccagtaacacagaagccaccaagtacagtatagcctgataatatgttgatttcttagctgacattaatatttcttgcttccttgtgttcccacccttggcactgccacccacccctcaattcaggcaacaatgaaattaatggataccgtctgcccttggcccagaattgttatagcaaaaattttagaaccaaaaaataagtctgtactaatttcaatgtggcttttaaaagtatgacagagaaataagttaggataaaggaaatttgaatctca

SEQ ID NO: 16900 - DNA, 1060 bp, Homo sapiens
gctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtgaatcccatcctggaagggaaggtaagattgagactggttacagttgaagcggcagtatgaaaggaaggaaagtgggagggcgttgtggacatgaatgtggttgaaagttgtaggggaattgggaagtggcatgatgatgacacaggagccccctcggacccattgatctcatgtctgccctgttgcaggtgcatcgccatctacaggagcagaagaatggacttgctaaatgacctagcactattctctggccc

SEQ ID NO: 16901 - DNA, 1522 bp, Homo sapiens
ggcagggtttggtttgggtgtcttcagattgccttgtctcgaggtcctcacaattgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtcttcatcatccgaggcctgcgttcagttggtgcttccagacaccaagggcccttgtgaatcccatcctggaatggaaggtgcatcgccatctacaggagcagaagagtggacttgctacatgacctagcattattttctggccccatttatcatatcccttttctcctccaaatgtttctcctctcacctcttctgtgggacttaaattgctatatctgctcagagctcacaaatgcctttgaattatttccctgacttcctgatttttttcttcttaagtgttacctactaagagttgcctggagtaagccacccagctacctaattcctcagtaacctccatctataatctccatggaagcaacaaattccctttatgagatatatgtcaaatttttccatctttcatccagggctgactgaaaccgtggctaagaattgggagactctcttgtttcaagccaatttaacatcatttaccagatcatttgtcatgtccagtaacacagaagcaaccaactacagtatagcctgataacatgatttcttagctgacattaatatttctttcttccttgtgttcccacccttggcattgccacccacccctcaattaaggcaacaatgaagttaatggataccctctgcctttggctcagaaatgttatagcaaaaattttaaaataaaaaagtaagtctgtactaatttcaa

SEQ ID NO: 16902 - DNA, 1206 bp, Homo sapiens
tcctcacaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtgaatcccatcctggaagggaagggctgactgaaactatggctaataattggggtactcttatgtttcaatccaatttaacctcatttcccagatcatttttcatgtccagtaacacagaagccaccaagtacagtatagcctgataatatgttgatttcttagctgacattaatatttcttgcttccttgtgttcccacccttggcactgccacccacccctcaattcaggcaacaatgaaattaatggataccgtctgcccttggcccagaattgttatagcaaaaattttagaaccaaaaaataagtctgtactaatttcaatgtggcttttaaaagtatgacagagaaataagttaggataaaggaaatttgaatctca

SEQ ID NO: 16903 - DNA, 1385 bp, Homo sapiens
ggcagggtttggtttgggtgtcttcagatttccttgtcttgaggtcctcacaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtgaatcccatcctggaagggaagatgttacctacaaagacatgcctggggtaagccacccggctacctaattcctcagtaacctccatctaaaatctccaaggaagcaataaattccttttatgagatctatgtcaaatttttccatctttcatccagggctgactgaaactatggctaataattggggtactcttatgtttcaatccaatttaacctcatttcccagatcatttttcatgtccagtaacacagaagccaccaagtacagtatagcctgataatatgttgatttcttagctgacattaatatttcttgcttccttgtgttcccacccttggcactgccacccacccctcaattcaggcaacaatgaaattaatggataccgtctgcccttggcccagaattgttatagcaaaaattttagaaccaaaaaataagtctgtactaatttcaatgtggcttttaaaagtatgacagagaaataagttaggataaaggaaatttgaatctca

SEQ ID NO: 16904 - DNA, 1103 bp, Homo sapiens
aggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtcttcatcatccgaggcctgcgttcagttggtgcttccagacaccaagggcccttgtgaatcccatcctggaatggaagggctgactgaaaccgtggctaagaattgggagactctcttgtttcaagccaatttaacatcatttaccagatcatttgtcatgtccagtaacacagaagcaaccaactacagtatagcctgataacatgatttcttagctgacattaatatttctttcttccttgtgttcccacccttggcattgccacccacccctcaattaaggcaacaatgaagttaatggataccctctgcctttggctcagaaatgttatagcaaaaattttaaaataaaaaagtaagtctgtactaatttcaa

SEQ ID NO: 16905 - DNA, 1237 bp, Homo sapiens
aggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtcttcatcatccgaggcctgcgttcagttggtgcttccagacaccaagggcccttgtgaatcccatcctggaatggaagtgttacctactaagagttgcctggagtaagccacccagctacctaattcctcagtaacctccatctataatctccatggaagcaacaaattccctttatgagatatatgtcaaatttttccatctttcatccagggctgactgaaaccgtggctaagaattgggagactctcttgtttcaagccaatttaacatcatttaccagatcatttgtcatgtccagtaacacagaagcaaccaactacagtatagcctgataacatgatttcttagctgacattaatatttctttcttccttgtgttcccacccttggcattgccacccacccctcaattaaggcaacaatgaagttaatggataccctctgcctttggctcagaaatgttatagcaaaaattttaaaataaaaaagtaagtctgtactaatttcaa

SEQ ID NO: 16906 - DNA, 520 bp, Homo sapiens
aagagcaaaataatatgaaaagtatttaacaaggaatataaagaatcatcaaagaaaatgttataaaacttctttgagaccacaagagatgatagagatggggtttcactgtgttagcgaggatggtcttgatctcctgacctcgtgatccgcctgcttctgcctcccaaagtgctgggattacagtcgtgagccaccgcgcctggcctcctcatattattttttattgtgcagtttattcaagagagctttccagcacctgtgataagcctcagcccgcctgctggataatgagcccacatggattgagagaggcctcctatccctgccaaacctattgatgctacagagatgtgagggagcccacctgagaaaagctgaacctgcccagtacataaaaaccactcagctcagaacagcaactgctgaggctgccttgggaagaagatgatcctaaacaaagctctgatgctgggggccctcgccctgaccaccgtgatgagcccttgtggaggtgaag

SEQ ID NO: 16907 - DNA, 1203 bp, Homo sapiens
tcctcacaattactctacagctcagaacagcaactgctgaggctgccttgggaagaagatgatcctaaacaaagctctgatgctgggggccctcgccctgaccaccgtgatgagcccttgtggaggtgaagacattgtggctgaccacgttgcctcttacggtgtaaacttgtaccagtcttacggtccctctggccagttcacccatgaatttgatggagacgaggagttctatgtggacctggagaggaaggagactgtctggaagttgcctctgttccacagacttagatttgacccgcaatttgcactgacaaacatcgctgtgctaaaacataacttgaacatcctgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccagcacctatgtcagagctcacagagactgtggtctgtgccctggggttgtctgtgggcctcgtgggcattgtggtggggaccgtcttgatcatccgaggcctgcgttcagttggtgcttccagacaccaagggcccttgtgaatcccatcctgaaaaagaagggctgactgaacctatggctaagaattgggacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcaca

SEQ ID NO: 16908 - DNA, 1217 bp, Homo sapiens
ggcagggtttggtttgggtgtcttcagatttccttgtcttgaggccctcacaattgctctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgcatcaccatctacagcagcggaagagtggacttgctacatgacctagcactattctctggcccgatttatcataccctttttctcctgcaaatgtttctcctcttaccttttctctgctttttttttcttaagcttctgtatcccctcagagctcacaaatgcctttgaattctttccctgacctcctgatttttttttcttttctcaggtgttacctactaagagatgcctggggtaagccgcccagctacctaattcctcagtaacatcgatctaaaatctccatggaagcaataaattccctttaagagatctatgtcaaa

SEQ ID NO: 16909 - DNA, 1001 bp, Homo sapiens
aacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgatgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtaagattgagatttgttagagctgaagctgcaggaaggaaagtgggaggaggctgtggacatgaatgtggttgaaagttgtaggggaattgggaagtggcatgatgatgacacaggagcccccttggacccatcgatctcatgtctgtcctgttgcaggtgcatcaccatctacagcag

SEQ ID NO: 16910 - DNA, 520 bp, Homo sapiens
aagagcaaaataatatgaaaagtatttaacaaggaatataaagaatcatcaaagaaaatgttataaaacttctttgagaccacaagagatgatagagatggggtttcactgtgttagcgaggatggtcttgatctcctgacctcgtgatccgcctgcttctgcctcccaaagtgctgggattacagtcgtgagccaccgcgcctggcctcctcatattattttttattgtgcagtttattcaagagagctttccagcacctgtgataagcctcagcccgcctgccggataatgagcccacatggattgagagaggcctcctatccctgccaaacctattgatgctacagagatgtgagggagcccacctgagaaaagctgaacctgcccagtacataaaaaccactcagctcagaacaccaactgctgaggctgccttgggaagaggatgatcctaaacaaagctctgctgctgggggccctcgctctgaccaccgtgatgagcccctgtggaggtgaag

SEQ ID NO: 16911 - DNA, 1548 bp, Homo sapiens
acaattgctctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgatgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgcatcaccatctacagcagcggaagagtggacttgctacatgacctagcactattctctggcccgatttatcataccctttttctcctgcaaatgtttctcctcttaccttttctctgctttttttttcttaagcttctgtatcccctcagagctcacaaatgcctttgaattctttccctgacctcctgatttttttttcttttctcaggtgttacctactaagagatgcctggggtaagccgcccagctacctaattcctcagtaacatcgatctaaaatctccatggaagcaataaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcaca

SEQ ID NO: 16912 - DNA, 1203 bp, Homo sapiens; identical to SEQ ID NO: 16907

SEQ ID NO: 16913 - DNA, 1049 bp, Homo sapiens
gctcagaacagcaactgctgaggctgccttgggaagaagatgatcctaaacaaagctctgatgctgggggccctcgccctgaccaccgtgatgagcccttgtggaggtgaagacattgtggctgaccacgttgcctcttacggtgtaaacttgtaccagtcttacggtccctctggccagttcacccatgaatttgatggagacgaggagttctatgtggacctggagaggaaggagactgtctggaagttgcctctgttccacagacttagatttgacccgcaatttgcactgacaaacatcgctgtgctaaaacataacttgaacatcctgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccagcacctatgtcagagctcacagagactgtggtctgtgccctggggttgtctgtgggcctcgtgggcattgtggtggggaccgtcttgatcatccgaggcctgcgttcagttggtgcttccagacaccaagggcccttgtgaatcccatcctgaaaaagaaggtaagtttgagatttgttagagctgaagctgcaggaaggaaagtgggaggaggctgtggacatgaatgtggttgaaagttgtaggggaattgggaagtggcatgatgatgacacaggagcccccttggacccatcgatctcatgtctgtcctgttgcaggtgcatcaccatctacagcagcggaagagtggacttgctacatgacctagcactattctctggccc

SEQ ID NO: 16914 - DNA, 1594 bp, Homo sapiens
ggcagggtttggtttgggtgtcttcagatttccttgtcttgaggtcctcacaattactctacagctcagaacagcaactgctgaggctgccttgggaagaagatgatcctaaacaaagctctgatgctgggggccctcgccctgaccaccgtgatgagcccttgtggaggtgaagacattgtggctgaccacgttgcctcttacggtgtaaacttgtaccagtcttacggtccctctggccagttcacccatgaatttgatggagacgaggagttctatgtggacctggagaggaaggagactgtctggaagttgcctctgttccacagacttagatttgacccgcaatttgcactgacaaacatcgctgtgctaaaacataacttgaacatcctgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccagcacctatgtcagagctcacagagactgtggtctgtgccctggggttgtctgtgggcctcgtgggcattgtggtggggaccgtcttgatcatccgaggcctgcgttcagttggtgcttccagacaccaagggcccttgtgaatcccatcctgaaaaagaaggtgcatcaccatctacagcagcggaagagtggacttgctacatgacctagcactattctctggcccgatttatcataccctttttctcctgcaaatgtttctcctcttaccttttctctgcttttttttccttaagcttctgtatcccctcagagctcacaaatgcctttgaattctttccctgacctcctgatttttttttcttttctcaggtgttacctactaagagatgcctggggtaagccgcccagctacctaattcctcagtaacatcgatctaaaatctccatggaagcaataaattccctttaagagatctatgtcaaatttttccatctttcatccggggctgactgaacctatggctaagaattgggacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcaca

SEQ ID NO: 16915 - DNA, 922 bp, Homo sapiens
aggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgttacctactaagagatgcctggggtaagccgcccagctacctaattcctcagtaacatcgatctaaaatctccatggaagcaataaattccctttaagagatctatgtcaaa

SEQ ID NO: 16916 - DNA, 520 bp, Homo sapiens
aagagcaaaataatatgaaaagtatttaacaaggaatataaagaatcatcaaagaaaatgttataaaacttctttgagaccacaagagatgatagagatggggtttcactgtgttagcgaggatggtcttgatctcctgacctcgtgatccgcctgcttctgcctcccaaagtgctgggattacagtcgtgagccaccgcgcctggcctcctcatattattttttattgtgcagtttattcaagagagctttccagcacctgtgataagcctcagcccgcctgccggataatgagcccacatggattgagagaggcctcctatccctgccaaacctattgatgctacagagatgtgagggagcccacctgagaaaagctgaacctgcccagtacataaaaaccactcagctcagaacagcaactgctgaggctgccttgggaagaggatgatcctaaacaaagctctgatgctgggggccctcgccctgaccaccgtgatgagcccttgtggaggtgaag

SEQ ID NO: 16917 - DNA, 520 bp, Homo sapiens; identical to SEQ ID NO: 16906

SEQ ID NO: 16918 - DNA, 1206 bp, Homo sapiens
ccctcacaattgctctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgatgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaagggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcaca

SEQ ID NO: 16919 - DNA, 1049 bp, Homo sapiens; identical to SEQ ID NO: 16913

SEQ ID NO: 16920 - DNA, 1382 bp, Homo sapiens
ggcagggtttggtttgggtgtcttcagatttccttgtcttgaggtcctcacaattactctacagctcagaacagcaactgctgaggctgccttgggaagaagatgatcctaaacaaagctctgatgctgggggccctcgccctgaccaccgtgatgagcccttgtggaggtgaagacattgtggctgaccacgttgcctcttacggtgtaaacttgtaccagtcttacggtccctctggccagttcacccatgaatttgatggagacgaggagttctatgtggacctggagaggaaggagactgtctggaagttgcctctgttccacagacttagatttgacccgcaatttgcactgacaaacatcgctgtgctaaaacataacttgaacatcctgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccagcacctatgtcagagctcacagagactgtggtctgtgccctggggttgtctgtgggcctcgtgggcattgtggtggggaccgtcttgatcatccgaggcctgcgttcagttggtgcttccagacaccaagggcccttgtgaatcccatcctgaaaaagaaggtgttacctactaagagatgcctggggtaagccgcccagctacctaattcctcagtaacatcgatctaaaatctccatggaagcaataaattccctttaagagatctatgtcaaatttttccatctttcatccggggctgactgaacctatggctaagaattgggacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcaca

SEQ ID NO: 16921 - DNA, 1594 bp, Homo sapiens; identical to SEQ ID NO: 16914

SEQ ID NO: 16922 - DNA, 1385 bp, Homo sapiens
ggcagggtttggtttgggtgtcttcagatttccttgtcttgaggccctcacaattgctctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgatgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgttacctactaagagatgcctggggtaagccgcccagctacctaattcctcagtaacatcgatctaaaatctccatggaagcaataaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcaca

SEQ ID NO: 16923 - DNA, 1382 bp, Homo sapiens; identical to SEQ ID NO: 16920

SEQ ID NO: 16924 - DNA, 696 bp, Homo sapiens
acaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactggggtgcatcgccatctacaggagcagaagaat

SEQ ID NO: 16925 - DNA, 674 bp, Homo sapiens
attgctctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactggggtttgttacac

SEQ ID NO: 16926 - DNA, 943 bp, Homo sapiens
acaattgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatgtgcatcgccatctacaggagcagaagagtggacttgctacatgacctagcattattttctggccccatttatcatatcccttttctcctccaaatgtttctcctctcacctcttctgtgggacttaaattgctatatctgctcagagctcacaaatgcctttgaattatttccctgacttcctgatttttttcttcttaagtgttacctactaagagttgcctggagtaagccacccagctacctaattcctcagtaacctccatctataatctccatggaagcaacaaattccctttatgagatatatgtcaaatttttccatctttcatccagggctgactgaaaccgtggctaagaattgggagactctcttgtttcaagccaatttaacatcatttaccagatcatttgtcatgtccagtaacacagaagcaaccaactacagtatagcctgataacatgatttcttagctgacattaatatttctttcttccttgtgttcccacccttggcattgccacccacccctcaattaaggcaacaatgaagttaatggataccctctgcctttggctcagaaatgttatagcaaaaattttaaaataaaaaagtaagtctgtact

SEQ ID NO: 16927 - DNA, 794 bp, Homo sapiens
acaattgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactggggtaaggatgagttccaccactttttgatgctttcttgtctgtcaagttcagaacttcctgccttttactcctatatcccaaaacttgttttccacacttcatgggtttctttctttcttatttttttcttc

SEQ ID NO: 16928 - DNA, 701 bp, Homo sapiens
attgctctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggaatctcagtctagagaatctgaagaaagcaccaaatca

SEQ ID NO: 16929 - DNA, 683 bp, Homo sapiens
acaattgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggttcatgggtttctttctttc

SEQ ID NO: 16930 - DNA, 704 bp, Homo sapiens
attgctctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactggggcattcaggcagaagaaggccagcgaagaaagaaactaggt

SEQ ID NO: 16931 - DNA, 255 bp, Homo sapiens
aacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactggggtaaggacttcatgagtttcttttat

SEQ ID NO: 16932 - DNA, 764 bp, Homo sapiens
attgctctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactggggtaaggatgagtttcaccattttttgatgctttcttgtctgtcaagttcagaacttcctgccttttactatatcccaaaacttgttttccacacttcatga

SEQ ID NO: 16933 - DNA, 1517 bp, Homo sapiens
ggcagggtttggtttgggtgtcttcagatttgcttgtctcgaggtcctcacaattgctctacagctcagagcagcaactgctgaggctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctacgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttgatgcttccagacaccaagggctcttatgaatctcatcctgaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgagtaagccactcagctacctaattcctcaatgacctttatctaaaatctccatggaagcaataaattcccttttgatgcctctattgaatttttcccatctttcatctcagggctgactgagagcataacttagaatgggtgactcttatgttttaggccaatttcatgtcattccccagatcatatttcatgtccagtaacacaggagcaaccaagtacagtgtatcctgataatttgttgatttcttaactggtgttaatatttctttcttccttttgttcctacccttggccactgccacccacccctcaattcaggtaccaacgaaccctctgcccttggctcagaatggttatagcagaaatacaaaaaaaaaaaaaaaaagtctgtact

SEQ ID NO: 16934 - DNA, 1524 bp, Homo sapiens
ggcagggtttggtttgggtgtcttcagatttgcttgtctcgaggtcctcacaattgctctacagctcagagcagcaactgctgaggctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctatgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatgaatcccatcctgaaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgggtaagccactcagctacctaattcctcaatgacctttatctaaaatctccatggaagcaataaattcccttttgatgcctctattgaatttttcccatctttcatctcagggctgactgagagcataacttagaatgggcgactcttatgttttaggccaatttcatatcattccccagatcatatttcaagtccagtaacacaggagcaaccaagtacagtgtatcctgataatttgttgatttcttaactggtgttaatatttctttcttccttttgttcctacccttggccactgccagccacccctcaattcaggtaccaacgaaccctctgcccttggctcagaatggttatagcagaaatacaaaaaaaaaaaaaaagtctgtactaatttcaa

SEQ ID NO: 16935 - DNA, 1521 bp, Homo sapiens
ggcagggtttggtttgggtgtcttcagatttgcttgtctcgaggtcctcacaattgctctacagctcagagcagcaactgctgaggctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctatgtggacctggagacgaaagagactgtctggcagttgcctatgtttagcaaatttataagttttgacccgcagagtgcactgagaaatatggctgtgggaaaacacaccttggaattcatgatgggacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatgaatcccatcctgaaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgggtaagccactcagctacctaattcctcaatgacctttatctaaaatctccatggaagcaataaattcccttttgatgcctctattgaatttttcccatctttcatctcagggctgactgagagcataacttagaatgggcgactcttatgttttaggccaatttcatatcattccccagatcatatttcaagtccagtaacacaggagcaaccaagtacagtgtatcctgataatttgttgatttcttaactggtgttaatatttctttcttccttttgttcctacccttggccactgccagccacccctcaattcaggtaccaacgaaccctctgcccttggctcagaatggttatagcagaaatacaaaaaaaaaaaaaaaagtctgtactaatt

SEQ ID NO: 16936 - DNA, 1725 bp, Homo sapiens
ggcagggtttggtttgggtgtcttcagatttgcttgtctcgaggtcctcacaattgctctacagctcagagcagcaactgctgagcctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctatgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatgaatcccatcctgaaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgggtaagccactcagctacctaattcctcaatgacctttatctaaaatctccatggaagcaataaattcccttttgatgcctctattgaatttttcccatctttcatctcagggctgactgagagcataacttagaatgggcgactcttatgttttaggccaatttcatatcattccccagatcatatttcaagtccagtaacacaggagcaaccaagtacagtgtatcctgataatttgttgatttcttaactggtgttaatatttctttcttccttttgttcctacccttggccactgccagccacccctcaattcaggtaccaacgaaccctctgcccttggctcagaatggttatagcagaaatacaaaaaaaaaaaaaaaagtctgtactaatttcaatatggctcttaaaaggaatgacagagaaataggatacaagaattttgaatctcaaaagttatcaaaagtaaaaaattttgttaccaaaagtcaaactgcattctcaaaactttaaatttgtgaagaatgacaacagtagaagctttcctctccccttctcaccttgaggagataaaaattctctaggcaggaaaagaaat

SEQ ID NO: 16937 - DNA, 1499 bp, Homo sapiens
ggcagggtttggtttgggtgtcttcagatttgcttgtctcgaggtcctcacaattgctctgcagctcagagcagcaactgctgaggctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagatgaggagttctacgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgcgggcctcatgggcattgtggtgggcactgtcttcatcatccaaggcctgcgttcagttggtgcttccagacaccaagggctcttgtgaatcccatcctgaaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatacctttcaattctttccctgacctcctttcctgaatttttttattttctcaaatgttacctactaagggatgcctgggtaagccacttagctacctaattcctcaatgacctttatctaaaatctccatggaagcaataaattcccttttatgatgcctctattgaatttttcccatctttcatctcagggctgactgagagcataacttagaatgggcgactcttatgttttaggccaatttcatatcattccccagatcatatttcatgtccagtaacacaggagcaaccaagtacagtgtatcctgataatttgttgatttcttaactggtgttaatatttctttcttccttttgttcctacccttggccactgccacccacccttcaattcaggtaccaacgaaccctctgcccttggctcagaatggttatagcagaaatccaaaaa

SEQ ID NO: 16938 - DNA, 1500 bp, Homo sapiens
ggtgtcttcagatttgcttgtctcgaggtcctcacaattgctctacagctcagagcagcaactgctgaggctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctacgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatgaatctcatcctgaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgagtaagccactcagctacctaattcctcaatgacctttatctaaaatctccatggaagcaataaattcccttttgatgcctctattgaatttttcccatctttcatctcagggctgactgagagcataacttagaatgggtgactcttatgttttaggccaatttcatgtcattccccagatcatatttcatgtccagtaacacaggagcaaccaagtacagtgtatcctgataatttgttgatttcttaactggtgttaatatttctttcttccttttgttcctacccttggccactgccacccacccctcaattcaggtaccaacgaaccctctgcccttggctcagaatggttatagcagaaatacaaaaaaaaaaaaaaaagtctgtact

SEQ ID NO: 16939 - DNA, 1648 bp, Homo sapiens
gaggtcctcacaattgctctacagctcagagcagcaactgctgagcctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctatgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatgaatcccatcctgaaaaggaaggtaagattgagatttgttggagctgaaacctcagtatgagagggaggaaagtgggagggggttgtggacatgaatgtggttgaaagttgtaggcgaattgggaagtggcatgatgatcacacaggaggcccctcagacccatcgatctcatgtctgtcctgttgcaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgggtaagccactcagctacctaattcctcaatgacctttatctaaaatctccatggaagcaataaattcccttttgatgcctctattgaatttttcccatctttcatctcagggctgactgagagcataacttagaatgggcgactcttatgttttaggccaatttcatatcattccccagatcatatttcaagtccagtaacacaggagcaaccaagtacagtgtatcctgataatttgttgatttcttaactggtgttaatatttctttcttccttttgttcctacccttggccactgccagccacccctcaattcaggtaccaacgaaccctctgcccttggctcagaatggttatagcagaaatacaaaaaaaaaaaaaaaagtctgtactaatt

SEQ ID NO: 16940 - DNA, 1201 bp, Homo sapiens
ggcagggtttggtttgggtgtcttcagatttgcttgtctcgaggtcctcacaattgctctgcagctcagagcagcaactgctgaggctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagatgaggagttctacgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgcgggcctcatgggcattgtggtgggcactgtcttcatcatccaaggcctgcgttcagttggtgcttccagacaccaagggctcttgtgaatcccatcctgaaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatacctttcaattctttccctgacctcctttcctgaatttttttattttctcaaatgttacctactaagggatgcctgggtaagccacttagctacctaattcctcaatgacctttatctaaaatctccatggaagcaataaattcccttttatga

SEQ ID NO: 16941 - DNA, 1710 bp, Homo sapiens
tcctcacaattgctctacagctcagagcagcaactgctgagcctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctatgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatgaatcccatcctgaaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgggtaagccactcagctacctaattcctcaatgacctttatctaaaatctccatggaagcaataaattcccttttgatgcctctattgaatttttcccatctttcatctcagggctgactgagagcataacttagaatgggcgactcttatgttttaggccaatttcatatcattccccagatcatatttcaagtccagtaacacaggagcaaccaagtacagtgtatcctgataatttgttgatttcttaactggtgttaatatttctttcttccttttgttcctacccttggccactgccagccacccctcaattcaggtaccaacgaaccctctgcccttggctcagaatggttatagcagaaatacaaaaaaaaaaaaaaaagtctgtactaatttcaatatggctcttaaaaggaatgacagagaaataggatacaagaattttgaatctcaaaagttatcaaaagtaaaaaattttgttaccaaaagtcaaactgcattctcaaaactttaaatttgtgaagaatgacaacagtagaagctttcctctccccttctcaccttgaggagataaaaattctctaggcaggaaaagaaatggaagccagttagaaaaacattgaaataa

SEQ ID NO: 16942 - DNA, 246 bp, Homo sapiens
gaccatgttgcctcctatggtgtgaacttctaccagtctcacggtccctctggccagtacacccatgaatttgatggagacgaggagttctacgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaat

SEQ ID NO: 16943 - DNA, 768 bp, Homo sapiens
atgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctacgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatga

SEQ ID NO: 16944 - DNA, 81 bp, Homo sapiens
atgatcctaaacaaagctctgctgctgggggccctcgccctgactgccgtgatgagcccctgtggaggtgaagacattgtg

SEQ ID NO: 16945 - DNA, 1656 bp, Homo sapiens
attctttctgccaggtacatcagatccatcaggtccgagctgtgttgactaccactgcttttcccttcgtctcagttatgtcttggaagaaggctttgcggatccccggagaccttcgggtagcaactgtcaccttgatgctggcgatgctgagctccctactggctgagggcagagactctcccgaggatttcgtgttccagtttaagggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaaggacctcaagggcctccaccagcagggcttctgcactgactcctgagactattttaactaggattggttatcactcttctgtgatgcctgcttatgcctgcccagaattcccagctgcctgtgtcagcttgtccccctgagatcaaagtcctacagtggctgtcacgcagccaccaggtcatctcctttcatccccaccccaaggcgctggctgtgactctgcttcctgcactgacccagagcctctgcctgtgcatggccagctgcgtctactcaggtcccaaggggtttctgtttctattctttcctcagactgctcaagagaagcacatgaaaaacattacctgactttagagcttttttacataattaaacatgatcctgagttatctgtattctgaactttcttaattgagaagaggcaggaaatcactgcagaatgaaggaacatcccttgaggtgacccagcaaacctgtggccagaaggaggattgtaccttgaaaagacactgaaagcattttggggtgtgaagtaagggtgggcagaggaggtagaaaataattcaattgtcgcatcattcatggttctttaatactgatgctcagtgcattggccttagaatatcccagcctctcttctggtttggtgagtgctgtgtaaataagcatggtagaattgtttggagacatatatagtgatccttggtcactggtgtttcaaacattctggaaagtcacatcgatcaagaatattttttatttttaagaaagcataaccagcaataaaaatactatttttgagtctaaa

SEQ ID NO: 16946 - DNA, 1649 bp, Homo sapiens
atcagatccatcaggtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatgaccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcctctgcctgtgcacggccagctgcatctactcaggccccaaggggtttctgtttctattctctcctcagactgctcaagagaagcacatgaaaaccattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgttgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaatgatagaaacccaaatatattttgttcatggtgcaaa

SEQ ID NO: 16947 - DNA, 1649 bp, Homo sapiens; identical to SEQ ID NO: 16946

SEQ ID NO: 16948 - DNA, 1788 bp, Homo sapiens
gcactggattgagaaccttcacaaaaaaaaatctgcccagagacagatgaggtccttcagctccagtgctgattggttcctttccaagggaccatccaatcctaccacgcatggaaacatccacaggtttttattctttctgccaggtacatcagatccatcaggtccgagctgtgttgactaccactacttttcccttcgtctcaattatgtcttggaaaaaggctttgcggatccccggaggccttcgggcagcaactgttaccttgatgctggcgatgctgagcaccccagtggctgagggcagagactctcccgaggatttcgtgtaccagtttaaggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatggagacgtctacacctgccacgtggagcaccccagcctccagaaccccatcaccgtggagtggcgggctcagtctgaatctgcccagagcaagatgctgagtggcattggaggcttcgtgctggggctcatcttcctcgggctgggccttattatccatcacaggagtcagaaaggacctcaagggcctccaccagcagggctcctgcactgactcctgagactattttaactgggattggttatcacttttctgtaacgcctgcttgtccctgcccagaattcccaactgcctgtgtcagcctgtccccctgagatcagagtcctacagtggctgtcacgcagccaccaggtcatctcctttcatccccaccccaaggcgctggctgtgactctgcttcctgcactgacccagagcctctgcctgtgcatggccagctgcgtctactcaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 16949 - DNA, 1789 bp, Homo sapiens
actggattgagaaccttcacaaaaaaaaaatgtctgcctagagacagattaggtccttcagctccagtgctgattggttcctttccaaaggaccatccaatcctgccacgcagggaaacatccacaggtttttattctttctgccaggtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcgggctcagtctgaatctgcccagagcaagatgctgagtggcattggaggcttcgtgctggggctgatcttcctcgggctgggccttattatccatcacaggagtcagaaaggacctcaagggcctccaccagcagggctcctgcactgactcctgagactattttaactgggattggttatcacttttctgtaacgcctgcttgtccctgcccagaattcccagctgcctgtgtcagcctgtcccccgagatcagagtcctacagtggctgtcacgcagccaccaggtcatctcctttcatccccacctcaaggctgatggctgtgaccctgcttcctgcactgacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaattttgggtgcaaagtcagggtgggcagaggaggtagaagatcaactcagttgtcgcatcattcatggttctttcatattgatgttcaatgcagtggcctgagaatatcccagcctctcttctggtttggtgagtgctatataagtaagcatggtggaattgtttgggggcagatatagtgacccttggtcactggtgtttcaaacattctggcaagtcacatcaatcaagaataatttttacttttaagaaagcataaccagcaataaaagtattatttttgagtctaaa

SEQ ID NO: 16950 - DNA, 1501 bp, Homo sapiens
cagatccatcaggtccgagctgtgttgactaccactgcttttcccttcgtctcagttatgtcttggaagaaggctttgcggatccccggagaccttcgggtagcaactgtcaccttgatgctggcgatgctgagctccctactggctgagggcagagactctcccgaggatttcgtgttccagtttaagggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtggcggcttctgcactgactcctgagactattttaactaggattggttatcactcttctgtgatgcctgcttatgcctgcccagaattcccagctgcctgtgtcagcttgtccccctgagatcaaagtcctacagtggctgtcacgcagccaccaggtcatctcctttcatccccaccccaaggcgctggctgtgactctgcttcctgcactgacccagagcctctgcctgtgcatggccagctgcgtctactcaggtcccaaggggtttctgtttctattctttcctcagactgctcaagagaagcacatgaaaaacattacctgactttagagcttttttacataattaaacatgatcctgagttatctgtattctgaactttcttaattgagaagaggcaggaaatcactgcagaatgaaggaacatcccttgaggtgacccagcaaacctgtggccagaaggaggattgtaccttgaaaagacactgaaagcattttggggtgtgaagtaagggtgggcagaggaggtagaaaataattcaattgtcgcatcattcatggttctttaatactgatgctcagtgcattggccttagaatatcccagcctctcttctggtttggtgagtgctgtgtaaataagcatggtagaattgtttggagacatatatagtgatccttggtcactggtgtttcaaacattctggaaagtcacatcgatcaagaatattttttatttttaagaaagcataaccagcaataaaaatactatttttgagtctaaa

SEQ ID NO: 16951 - DNA, 1734 bp, Homo sapiens
aggatggattagagacctctattttgaggcgcactgatgtaggggctgaggaaggacattgagggcaccttcaggtctctctgcctattcttccttgccccaactccattccaggtgtacatcagatccatcaggtccgagctgtgttgactaccactgcttttcccttcgtctcagttatgtcttggaagaaggctttgcggatccccggagaccttcgggtagcaactgtcaccttgatgctggcgatgctgagctccctactggctgagggcagagactctcccgaggatttcgtgttccagtttaagggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaagggcttctgcactgactcctgagactattttaactaggattggttatcactcttctgtgatgcctgcttatgcctgcccagaattcccagctgcctgtgtcagcttgtccccctgagatcaaagtcctacagtggctgtcacgcagccaccaggtcatctcctttcatccccaccccaaggcgctggctgtgactctgcttcctgcactgacccagagcctctgcctgtgcatggccagctgcgtctactcaggtcccaaggggtttctgtttctattctttcctcagactgctcaagagaagcacatgaaaaacattacctgactttagagcttttttacataattaaacatgatcctgagttatctgtattctgaactttcttaattgagaagaggcaggaaatcactgcagaatgaaggaacatcccttgaggtgacccagcaaacctgtggccagaaggaggattgtaccttgaaaagacactgaaagcattttggggtgtgaagtaagggtgggcagaggaggtagaaaataattcaattgtcgcatcattcatggttctttaatactgatgctcagtgcattggccttagaatatcccagcctctcttctggtttggtgagtgctgtgtaaataagcatggtagaattgtttggagacatatatagtgatccttggtcactggtgtttcaaacattctggaaagtcacatcgatcaagaatattttttatttttaagaaagcataaccagcaataaaaatactatttttgagtctaaa

SEQ ID NO: 16952 - DNA, 1642 bp, Homo sapiens
acaggtttttattctttctgccaggtacatcagatccatcaggtccgagctgtgttgactaccactacttttcccttcgtctcaattatgtcttggaaaaaggctttgcggatccccggaggccttcgggcagcaactgttaccttgatgctggcgatgctgagcaccccagtggctgagggcagagactctcccgaggatttcgtgtaccagtttaaggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatggagacgtctacacctgccacgtggagcaccccagcctccagaaccccatcaccgtggagtggcgggctcagtctgaatctgcccagagcaagatgctgagtggcattggaggcttcgtgctggggctcatcttcctcgggctgggccttattatccatcacaggagtcagaaagggctcctgcactgactcctgagactattttaactgggattggttatcacttttctgtaacgcctgcttgtccctgcccagaattcccaactgcctgtgtcagcctgtccccctgagatcagagtcctacagtggctgtcacgcagccaccaggtcatctcctttcatccccaccccaaggcgctggctgtgactctgcttcctgcactgacccagagcctctgcctgtgcatggccagctgcgtctactcaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 16953 - DNA, 1473 bp, Homo sapiens
ctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatgaccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcctctgcctgtgcacggccagctgcatctactcaggccccaaggggtttctgtttctattctctcctcagactgctcaagagaagcacatgaaaaccattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgttgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttga

SEQ ID NO: 16954 - DNA, 1734 bp, Homo sapiens
aggatggattagaggcctctattctgagggacactgaggtgggggctgaggaaggacattgagggcagcttcaggtctctctgcctactcttccttgccccaactccattccaggtgtacatcagatccatcaggtccgagctgtgttgactaccactacttttcccttcgtctcaattatgtcttggaaaaaggctttgcggatccccggaggccttcgggcagcaactgttaccttgatgctggcgatgctgagcaccccagtggctgagggcagagactctcccgaggatttcgtgtaccagtttaaggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatggagacgtctacacctgccacgtggagcaccccagcctccagaaccccatcaccgtggagtggcgggctcagtctgaatctgcccagagcaagatgctgagtggcattggaggcttcgtgctggggctcatcttcctcgggctgggccttattatccatcacaggagtcagaaagggctcctgcactgactcctgagactattttaactgggattggttatcacttttctgtaacgcctgcttgtccctgcccagaattcccaactgcctgtgtcagcctgtccccctgagatcagagtcctacagtggctgtcacgcagccaccaggtcatctcctttcatccccaccccaaggcgctggctgtgactctgcttcctgcactgacccagagcctctgcctgtgcatggccagctgcgtctactcaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 16955 - DNA, 1643 bp, Homo sapiens
acaggtttttattctttctgccaggtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggaccgagcgcgtgcggggtgtgaccagatacatctataaccgagaggagtacgcgcgcttcgacagcgacgtgggggtgtatcgggcggtgacgccgctggggccgcctgccgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcgaggctgatggctgtgaccctgcttcctgcacttacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaagatcaactcagttgttgcatcattcatggttctttcatattgatgctcagtgcagtggcctgagaatatcccagcctctcttctggtttggtgagtgctatataagtaagcatggtggaattgtttgggggcagatatagtgacccttggtcactggtgtttcaaacattctggcaagtcacatcaatcaagaataatttttacttttaagaaagcataaccagcaataaaagtactatttttgattctaaa

SEQ ID NO: 16956 - DNA, 1483 bp, Homo sapiens
gagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcccctgcctgtgcacagccagctgcatctactcaggccccaaggggtttctgtttctattctctcctcagactgctcaagagaagcacatgaaaactattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 16957 - DNA, 1642 bp, Homo sapiens
acaggtttttattctttctgccaggtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtcccccgagatcagagtcctacagtggctgtcacgcagccaccaggtcatctcctttcatccccacctcaaggctgatggctgtgaccctgcttcctgcactgacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaattttgggtgcaaagtcagggtgggcagaggaggtagaagatcaactcagttgtcgcatcattcatggttctttcatattgatgttcaatgcagtggcctgagaatatcccagcctctcttctggtttggtgagtgctatataagtaagcatggtggaattgtttgggggcagatatagtgacccttggtcactggtgtttcaaacattctggcaagtcacatcaatcaagaataatttttacttttaagaaagcataaccagcaataaaagtattatttttgagtctaaa

SEQ ID NO: 16958 - DNA, 1640 bp, Homo sapiens
acagatttttattctttctgccaggtacatcagatccatcaggtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcccctgcctgtgcacagccagctgcatctactcaggccccaaggggtttctgtttctattctctcctcagactgctcaagagaagcacatgaaaactattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 16959 - DNA, 1787 bp, Homo sapiens
gcactggattcagaaccttcacacaaaaaaaatctgcccagagacagatgaggtccttcagctccagtgctgattggttcctttccaagggaccatccaatcctaccacgcatggaaacatccacagatttttattctttctgccaggtacatcagatccatcaggtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaaggacctcaagggcctccaccagcagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcccctgcctgtgcacagccagctgcatctactcaggccccaaggggtttctgtttctattctctcctcagactgctcaagagaagcacatgaaaactattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 16960 - DNA, 1734 bp, Homo sapiens
aggatgcattagaggcctctatcctgagggacactgatgtgggggctgaggaaggacattgagggcaccttcaggtctctctgcctattattccttgtgccaactccattccaggtgtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtcccccgagatcagagtcctacagtggctgtcacgcagccaccaggtcatctcctttcatccccacctcaaggctgatggctgtgaccctgcttcctgcactgacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaattttgggtgcaaagtcagggtgggcagaggaggtagaagatcaactcagttgtcgcatcattcatggttctttcatattgatgttcaatgcagtggcctgagaatatcccagcctctcttctggtttggtgagtgctatataagtaagcatggtggaattgtttgggggcagatatagtgacccttggtcactggtgtttcaaacattctggcaagtcacatcaatcaagaataatttttacttttaagaaagcataaccagcaataaaagtattatttttgagtctaaa

SEQ ID NO: 16961 - DNA, 1485 bp, Homo sapiens
gagctgtgttgactaccactacttttcccttcgtctcaattatgtcttggaaaaaggctttgcggatccccggaggccttcgggcagcaactgttaccttgatgctggcgatgctgagcaccccagtggctgagggcagagactctcccgaggatttcgtgtaccagtttaaggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatggagacgtctacacctgccacgtggagcaccccagcctccagaaccccatcaccgtggagtggcggctcctgcactgactcctgagactattttaactgggattggttatcacttttctgtaacgcctgcttgtccctgcccagaattcccaactgcctgtgtcagcctgtccccctgagatcagagtcctacagtggctgtcacgcagccaccaggtcatctcctttcatccccaccccaaggcgctggctgtgactctgcttcctgcactgacccagagcctctgcctgtgcatggccagctgcgtctactcaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 16962 - DNA, 1732 bp, Homo sapiens
aggatggattagaggcctctattctgagggacactgaggtgggggctgaggaaggacattgagggcagcttcaggtctctctgcctactcttccttgccccaactccattccaggtgtacatcagatccatcaggtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcccctgcctgtgcacagccagctgcatctactcaggccccaaggggtttctgtttctattctctcctcagactgctcaagagaagcacatgaaaactattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 16963 - DNA, 1217 bp, Homo sapiens
gtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcccctgcctgtgcacagccagctgcatctactcaggccccaaggggtttctgtttctattctctcctcagactgctcaagagaagcacatgaaaactattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 16964 - DNA, 1219 bp, Homo sapiens
gtccaagctgtgttgactaccactacttttcccttcgtctcaattatgtcttggaagaaggctttgcggatccctggaggccttcgggtagcaactgtgaccttgatgctggcgatgctgagcaccccggtggctgagggcagagactctcccgtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcggctcctgcactgactcctgagactattttaactgggattggttatcacttttctgtaacgcctgcttgtccctgcccagaattcccagctgcctgtgtcagcctgtcccccgagatcagagtcctacagtggctgtcacgcagccaccaggtcatctcctttcatccccacctcaaggctgatggctgtgaccctgcttcctgcactgacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaattttgggtgcaaagtcagggtgggcagaggaggtagaagatcaactcagttgtcgcatcattcatggttctttcatattgatgttcaatgcagtggcctgagaatatcccagcctctcttctggtttggtgagtgctatataagtaagcatggtggaattgtttgggggcagatatagtgacccttggtcactggtgtttcaaacattctggcaagtcacatcaatcaagaataatttttacttttaagaaagcataaccagcaataaaagtattatttttgagtctaaa

SEQ ID NO: 16965 - DNA, 484 bp, Homo sapiens
atcaggtccaagctgtgttgactaccactacttttcccttcgtctcaattatgtcttggaagaaggctttgcggatccctggaggccttcgggtagcaactgtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagca

SEQ ID NO: 16966 - DNA, 1219 bp, Homo sapiens
gtccgagctgtgttgactaccactacttttcccttcgtctcaattatgtcttggaaaaaggctttgcggatccccggaggccttcgggcagcaactgttaccttgatgctggcgatgctgagcaccccagtggctgagggcagagactctcccgtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatggagacgtctacacctgccacgtggagcaccccagcctccagaaccccatcaccgtggagtggcggctcctgcactgactcctgagactattttaactgggattggttatcacttttctgtaacgcctgcttgtccctgcccagaattcccaactgcctgtgtcagcctgtccccctgagatcagagtcctacagtggctgtcacgcagccaccaggtcatctcctttcatccccaccccaaggcgctggctgtgactctgcttcctgcactgacccagagcctctgcctgtgcatggccagctgcgtctactcaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 16967 - DNA, 1642 bp, Homo sapiens
acaggtttttattctttctgccaggtacatcagatccatcaggtccgagctgtgttgactaccactgcttttcccttcgtctcagttatgtcttggaagaaggctttgcggatccccggagaccttcgggtagcaactgtcaccttgatgctggcgatgctgagctccctactggctgagggcagagactctcccgaggatttcgtgttccagtttaagggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaagggcttctgcactgactcctgagactattttaactaggattggttatcactcttctgtgatgcctgcttatgcctgcccagaattcccagctgcctgtgtcagcttgtccccctgagatcaaagtcctacagtggctgtcacgcagccaccaggtcatctcctttcatccccaccccaaggcgctggctgtgactctgcttcctgcactgacccagagcctctgcctgtgcatggccagctgcgtctactcaggtcccaaggggtttctgtttctattctttcctcagactgctcaagagaagcacatgaaaaacattacctgactttagagcttttttacataattaaacatgatcctgagttatctgtattctgaactttcttaattgagaagaggcaggaaatcactgcagaatgaaggaacatcccttgaggtgacccagcaaacctgtggccagaaggaggattgtaccttgaaaagacactgaaagcattttggggtgtgaagtaagggtgggcagaggaggtagaaaataattcaattgtcgcatcattcatggttctttaatactgatgctcagtgcattggccttagaatatcccagcctctcttctggtttggtgagtgctgtgtaaataagcatggtagaattgtttggagacatatatagtgatccttggtcactggtgtttcaaacattctggaaagtcacatcgatcaagaatattttttatttttaagaaagcataaccagcaataaaaatactatttttgagtctaaa

SEQ ID NO: 16968 - DNA, 1484 bp, Homo sapiens
agctgtgttgactaccactacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcggctcctgcactgactcctgagactattttaactgggattggttatcacttttctgtaacgcctgcttgtccctgcccagaattcccagctgcctgtgtcagcctgtcccccgagatcagagtcctacagtggctgtcacgcagccaccaggtcatctcctttcatccccacctcaaggctgatggctgtgaccctgcttcctgcactgacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaattttgggtgcaaagtcagggtgggcagaggaggtagaagatcaactcagttgtcgcatcattcatggttctttcatattgatgttcaatgcagtggcctgagaatatcccagcctctcttctggtttggtgagtgctatataagtaagcatggtggaattgtttgggggcagatatagtgacccttggtcactggtgtttcaaacattctggcaagtcacatcaatcaagaataatttttacttttaagaaagcataaccagcaataaaagtattatttttgagtctaaa

SEQ ID NO: 16969 - DNA, 484 bp, Homo sapiens
atcaggtccgagctgtgttgactaccactgcttttcccttcgtctcagttatgtcttggaagaaggctttgcggatccccggagaccttcgggtagcaactgtgacgccgcaggggcggcctgatgccgagtactggaacagccagaaggaagtcctggaggggacccgggcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggactttccagatcctggtgatgctggaaatgactccccagcgtggagatgtctacacctgccacgtggagca

SEQ ID NO: 16970 - DNA, 481 bp, Homo sapiens
atcaggtccgagctgtgttgactaccacttttcccttcgtctcaattatgtcttggaaaaaggctttgcggatccccggaggccttcgggcagcaactgtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagca

SEQ ID NO: 16971 - DNA, 484 bp, Homo sapiens
atcaggtccgagctgtgttgactaccactacttttcccttcgtctcaattatgtcttggaaaaaggctttgcggatccccggaggccttcgggcagcaactgtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatggagacgtctacacctgccacgtggagca

SEQ ID NO: 16972 - DNA, 1421 bp, Homo sapiens
gactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcccctgcctgtgcacagccagctgcatctactcaggccccaaggggtttctgtttctattctctcctcagactgctcaagagaagcacatgaaaactattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 16973 - DNA, 1423 bp, Homo sapiens
gactaccactacttttcccttcgtctcaattatgtcttggaaaaaggctttgcggatccccggaggccttcgggcagcaactgttaccttgatgctggcgatgctgagcaccccagtggctgagggcagagactctcccgaggatttcgtgtaccagtttaaggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgacgccgagtactggaacagccagaaggaagtcctggagaggacccgggcggagttggacacggtgtgcagacacaactaccagttggagctccgcacgaccttgcagcggcgaggaacggtgactggaccttccagatcctggtgatgctggaaatgactccccagcatggagacgtctacacctgccacgtggagcaccccagcctccagaaccccatcaccgtggagtggcgggctcagtctgaatctgcccagagcaagatgctgagtggcattggaggcttcgtgctggggctcatcttcctcgggctgggccttattatccatcacaggagtcagaaagggctcctgcactgactcctgagactattttaactgggattggttatcacttttctgtaacgcctgcttgtccctgcccagaattcccaactgcctgtgtcagcctgtccccctgagatcagagtcctacagtggctgtcacgcagccaccaggtcatctcctttcatccccaccccaaggcgctggctgtgactctgcttcctgcactgacccagagcctctgcctgtgcatggccagctgcgtctactcaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 16974 - DNA, 783 bp, Homo sapiens
gactaccactgcttttcccttcgtctcagttatgtcttggaagaaggctttgcggatccccggagaccttcgggtagcaactgtcaccttgatgctggcgatgctgagctccctactggctgagggcagagactctcccgaggatttcgtgttccagtttaagggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagaggaatggtgactggactttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaagggcttctgcactgactcctgagactattttaactaggattggttatcactcttctgtgatgcctgcttatgcctgcccagaattcccagctgcctgtgtcagcttgtccccctgagatcaaagtcctacagtggctgtcacgc

SEQ ID NO: 16975 - DNA, 1455 bp, Homo sapiens
tgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcccctgcctgtgcacagccagctgcatctactcaggccccaaggggtttctgtttctattctctcctcagactgctcaagagaagcacatgaaaactattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaaaatcaactcagttgtcgcatcattcatggttctttcatattgatgttcagtgcagtggcctgagaatatcccagcctctcttctggtttggtgagtgctatataagtaaacatggtgga

SEQ ID NO: 16976 - DNA, 729 bp, Homo sapiens
atccatcaggtccaagctgtgttgactaccactacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggaccgagcgcgtgcggggtgtgaccagatacatctataaccgagaggagtacgcgcgcttcgacagcgacgtgggggtgtatcgggcggtgacgccgctggggccgcctgccgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcgtatggatgagttc

SEQ ID NO: 16977 - DNA, 1455 bp, Homo sapiens
tgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatgaccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcctctgcctgtgcacggccagctgcatctactcaggccccaaggggtttctgtttctattctctcctcagactgctcaagagaagcacatgaaaaccattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgttgcatcattcatggttctttcatattgatgttcagtgcagtggcctgagaatatcccagcctctcttctggtttggtgagtgctatataagtaaacatggtgga

SEQ ID NO: 16978 - DNA, 864 bp, Homo sapiens
atccatcaggtccaagctgtgttgactaccactacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggaccgagcgcgtgcggggtgtgaccagatacatctataaccgagaggagtacgcgcgcttcgacagcgacgtgggggtgtatcgggcggtgacgccgctggggccgcctgccgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcgggctcagtctgaatctgcccagagcaagatgctgagtggcattggaggcttcgtgctggggctgatcttcctcgggctgggccttattatccatcacaggagtcagaaagccctacctcaagggcctccaccagcaggtgatatttca

SEQ ID NO: 16979 - DNA, 1455 bp, Homo sapiens; identical to SEQ ID NO: 16977

SEQ ID NO: 16980 - DNA, 1230 bp, Homo sapiens
agtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgagtccatcctaaggtgactgtgtatccttcaaagacccagcccctgcagcaccataacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgttcttggcctgaagccccacagctttgatggcagtgcctcatcttcaacttttgtgctcccctttgcctaaaccctatggcctcctgtgcatctgtactcaccctgtaccacaaacacattacattattaaatgtttctcaaagatggagttaaa

SEQ ID NO: 16981 - DNA, 1229 bp, Homo sapiens
agtaacttcctccctataacttggaatgtgggtggaggggttcatagttctccctgagtgagacttgcctgcttctctggcccctggtcctgtcctgttctccagcatggtgtgtctgaagctccctggaggctcctgcatgacagcgctgacagtgacactgatggtgctgagctccccactggctttgtctggggacacccgaccacgtttcctgtggcagcctaagagggagtgtcatttcttcaatgggacggagcgggtgcggttcctggacagatacttctataaccaggaggagtccgtgcgcttcgacagcgacgtgggggagttccgggcggtgacggagctggggcggcctgacgctgagtactggaacagccagaaggacatcctggagcaggcgcgggccgcggtggacacctactgcagacacaactacggggttgtggagagcttcacagtgcagcggcgagtccaacctaaggtgactgtatatccttcaaagacccagcccctgcagcaccacaacctcctggtctgctctgtgagtggtttctatccaggcagcattgaagtcaggtggttcctgaacggccaggaagagaaggctgggatggtgtccacaggcctgatccagaatggagactggaccttccagaccctggtgatgctggaaacagttcctcgaagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaaatgcagatgaccacattcaaggaagaactttctgccccggctttgcaggatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatggcagcgcctcatcttcaacttttgtgctcccctttgcctaaaccgtatggcctcccgtgcatctgtattcaccctgtatgacaaacacattacattattaaatgtttctcaaagatggagttaaa

SEQ ID NO: 16982 - DNA, 1230 bp, Homo sapiens; identical to SEQ ID NO: 16980

SEQ ID NO: 16983 - DNA, 751 bp, Homo sapiens
cttttaaaactcaccagggacttcccacagaggcatgaaaaatatcagtcctgggcagggactttccacctatgtctgaaaaagaacaagtatcctgattcacgctctacattcattaagcatgctggatcttacttgaaaaggggagagttcttgtcaatccacacagctatcacctgtttctttctacaaatttcagcacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgaggtggacacctactgcagacacaactacggggttgtggagagcttcacagtgcagcggcgagtctatcctgaggtgactgtgtatcctgcaaagacccagcccctgcagcaccacaacctcctggtctgctctgtgaatggtttctatccaggcagcattgaagtcaggtggttccggaacggccaggaagagaagactggggtggtgtccacaggcctgatccagaatggagactggaccttccagaccctggtgatgctggaaacagttcctcggagtggagaggtttacacctgccaagtggagcacccaagcctgacgagccctctcacagtggaatgga

SEQ ID NO: 16984 - DNA, 753 bp, Homo sapiens
cccttttaaaactcaccagggacttcccacagaggcatgaaaaatatcagtcctgggcagggactttccacctatgtctgaaaaagaacaagtatcctgattcacgctctacattcattaagcatgctggatcttacttgaaaaggggagagttcttggcaatccacacagctatcacctgtttctttcgacaaatttcagcacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgagtccatcctaaggtgactgtgtatccttcaaagacccagcccctgcagcaccataacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatgga

SEQ ID NO: 16985 - DNA, 1191 bp, Homo sapiens
atagttctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgaggtggacacctactgcagacacaactacggggttgtggagagcttcacagtgcagcggcgagtctatcctgaggtgactgtgtatcctgcaaagacccagcccctgcagcaccacaacctcctggtctgctctgtgaatggtttctatccaggcagcattgaagtcaggtggttccggaacggccaggaagagaagactggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggcttcgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcagctctgcagaaaatgtcctcccttgtggctgcctcagctcgtacctttggcctgaagtcccagcattaatggcagcccctcatcttccaagttttgtgctcccctttacctaatgcttcctgcctcccatgcatctgtactcctgctgtgccacaaacacattacattattaaatgtttctcaaacatggagttaaaaa

SEQ ID NO: 16986 - DNA, 753 bp, Homo sapiens; identical to SEQ ID NO: 16984

SEQ ID NO: 16987 - DNA, 749 bp, Homo sapiens
ctcttttaaaactcaccagggacttcccacagaggcatgaaaaatatcagtcctgggcagggactttccacctatgtctgaaaaagaacaagtatcctgattcacgctctacattcattaagcatgctggatcttacttgaaaaggggagagttcttgtcaatccacacagctatcacctgtttctttctacaaatttcagcacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaa

SEQ ID NO: 16988 - DNA, 1235 bp, Homo sapiens
agtaacttcttccctataatttggaatgtgggtggagaggggtcatagttctccctgagtgagactcacctgctcctctggcccctggtcctgtcctgttctccagcatggtgtgtctgaagctccctggaggctcctgcatggcagctctgacagtgacactgatggtgctgagctccccactggctttggctggggacacccaaccacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatggagttaaaaa

SEQ ID NO: 16989 - DNA, 1180 bp, Homo sapiens
gttctccctgagtgagactcacctgctcctctggcccctggtcctgtcctgttctccagcatggtgtgtctgaagctccctggaggctcctgcatggcagctctgacagtgacactgatggtgctgagctccccactggctttggctggggacacccaaccacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatgga

SEQ ID NO: 16990 - DNA, 1120 bp, Homo sapiens
atgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggaccgagcgcgtgcggggtgtgaccagatacatctataaccgagaggagtacgcgcgcttcgacagcgacgtgggggtgtatcgggcggtgacgccgctggggccgcctgccgccgagtactggaacagccagaaggaagtcctggagaggacccgggcggagttggacacggtgtgcagacacaactaccagttggagctccgcacgaccttgcagcggcgagtctatcctgaggtgactgtgtatcctgcaaagacccagcccctgcagcaccacaacctcctggtctgctctgtgaatggtttctatccaggcagcattgaagtcaggtggttccggaacggccaggaagagaagactggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggcttcgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcagctctgcagaaaatgtcctcccttgtggctgcctcagctcgtacctttggcctgaagtcccagcattaatggcagcccctcatcttccaagttttgtgctcccctttacctaatgcttcctgcctcccatgcatctgtactcctgctgtgccacaaacacattacattattaaatgtttctc

SEQ ID NO: 16991 - DNA, 798 bp, Homo sapiens
ttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgaggtggacacctactgcagacacaactacggggttgtggagagcttcacagtgcagcggcgagtctatcctgaggtgactgtgtatcctgcaaagacccagcccctgcagcaccacaacctcctggtctgctctgtgaatggtttctatccaggcagcattgaagtcaggtggttccggaacggccaggaagagaagactggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggcttcgtgctgggcctgctcttccttggggccgggctgttcatctacttcaggaatcagaaaggacactctggacttcagccaacaggt

SEQ ID NO: 16992 - DNA, 446 bp, Homo sapiens
cactctggacttcagccaacaggtaataccttttcatcctctttaagaaacagatttggaggccaggcgcagcacgcctgtaatcccagcactttgggaggccgaggcgggcgaatcatgaggattcctgagctgaagtgaagatgaccacattcaaggaagaaccttctgccccagctttgcaggatgaaacacttccccgcttggctctcattcttccacaagagagacctttctccggacctggttgctactggttcagcagctctgcagaaaatgtcctcccttgtggctgcctcagctcgtacctttggcctgaagtcccagcattaatggcagcccctcatcttccaagttttgtgctcccctttacctaatgcttcctgcctcccatgcatctgtactcctgctgtgccacaaacacattacattattaaatgtttctc

SEQ ID NO: 16993 - DNA, 1167 bp, Homo sapiens
tctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgaggtggacacctactgcagacacaactacggggttgtggagagcttcacagtgcagcggcgagtctatcctgaggtgactgtgtatcctgcaaagacccagcccctgcagcaccacaacctcctggtctgctctgtgaatggtttctatccaggcagcattgaagtcaggtggttccggaacggccaggaagagaagactggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggcttcgtgctgggcctgctcttccttggggccgggctgttcatctacttcaggaatcagaaaggacactctggacttcagccaacaggtaataccttttcatcctctttaagaaacagatttggaggccaggcgcagtggctcacgcctgtaatcccagcactttgggaggccgaggcgggcgaatcatgaggtcaggagttcgagaccagcctgaccaacgtggtgaaaccccgtctctactaaaaatacaaaaaaaaatcagtcgggcgtggtggtgtgcgcctgtaatcccagctactcaggaggccaaggcaggagaatcgctggaacccgggaggcagaggttgcagtgagccgagattgggccactgcactccagcctaggtgacagagtgagaccccatctc

SEQ ID NO: 16994 - DNA, 1178 bp, Homo sapiens
atagttctccctgagtgagacttgcctgctcctctggcccctggtcctgtcctcttctccagcatggtgtgtctgaagctccctggaggctccagcttggcagcgttgacagtgacactgatggtgctgagctcccgactggctttcgctggggacacccgaccacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgccgagtactggaacagccagaaggacctcctggagcagaagcggggccaggtggacaattactgcagacacaactacggggttggtgagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacctgccaagtggagcacccaagcgtaacgagccctctcacagtggaatggagtgcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatgga

SEQ ID NO: 16995 - DNA, 1207 bp, Homo sapiens
ggtggaggggggtcatagttctccctgagtgagacttgcctgctcctctggcccctggtcctgtcctcttctccagcatggtgtgtctgaagctccctggaggctccagcttggcagcgttgacagtgacactgatggtgctgagctcccgactggctttcgctggggacacccgaccacgtttcttggagctgcgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacttgccaagtggagcacccaagcgtaacgagcgctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttctgccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctg

SEQ ID NO: 16996 - DNA, 1839 bp, Homo sapiens
cctccctataatttggaatgtgggtggaggggggtcatagttctccctgagtgagacttgcctgctcctctggcccctggtcctgtcctcttctccagcatggtgtgtctgaagctccctggaggctccagcttggcagcgttgacagtgacactgatggtgctgagctcccgactggctttcgctggggacacccgaccacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgccgagtactggaacagccagaaggacctcctggagcagaagcggggccaggtggacaattactgcagacacaactacggggttggtgagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacctgccaagtggagcacccaagcgtaacgagccctctcacagtggaatggagtgcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacagaataatgattttcacgtgtgtgtcatgagtatgtgaggtaatgtatatgttaaataccatgatttagtcattccacactataggcatataacaaaacttcatgcttccacataaatatgctatacaatttttacttgtcaattaaaaaagtaatgctaacatttaaaaaggcagtgcataaaaactgagaacagactataacaactgaaacaaacttggcaaaccgatgagaaaccagccagcaagtcaatcagaactcttcaccccatctacaatattttgtatttataactgtaaattagtgtatagtgtttcactccagagacttcaataatatagtgttatcaaaggacttgtacagatttcagagaaagacacatttagaagacggagaatggagtctccattatgttctacctgagagtcagtatgaaatgtcaaatataaaagtacataattcagaggtctatttcaaagtaataatcatttgagcataatttctccactgacagagacgactgttattttattttcaatcaaa

SEQ ID NO: 16997 - DNA, 1260 bp, Homo sapiens
atagttctccctgagtgagacttgcctgctcctctggcccctggtcctgtcctgttctccagcatggtgtgtctgaagctccctggaggttcctacatggcaaagctgacagtgacactgatggtgctgagctccccactggctttggctggggacacccgaccacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgctgagtactggaacagccagaaggacttcctggaagacaggcgcgccgcggtggacacctactgcagacacaactacggggttggtgagagcttcacagtgcagcggcgagttgagcctaaggtgactgtgtatcctgcaaggacccagaccctgcagcaccacaacctcctggtctgctctgtgaatggtttctatccaggcagcattgaagtcaggtggttccggaacagccaggaagagaaggctggggtggtgtccacaggcctgattcagaatggagactggaccttccagaccctggtgatgctggaaacagttcctcgaagtggagaggtttacacctgccaagtggagcacccaagcgtgacgagccctctcacagtggaatggagagcacagtctgaatctgcacagagcaagatgctgagtggagtcgggggctttgtgctgggcctgctcttccttggggccgggctattcatctacttcaagaatcagaaagggcactctggacttcacccaacaggactcgtgagctgaagtgcagatgaccacattcaagggggaaccttctgccccagctttgcatgatgaaaagctttcctgcttggctcttattcttccacaagagaggactttctcaggccctggttgctaccggttcagcaactctgcagaaaatgtccatccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccacctggctccaaagacaaaaaataaaaagaaaagaaaaagggaagattatttcctaata

SEQ ID NO: 16998 - DNA, 1154 bp, Homo sapiens
ggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagagcccccactggtcagagtaaatcgcaaagaaacttttccaggggttacagctctcttctgcaaagctcatggcttttaccccccagaaatttacatgacatggatgaaaaacggggaagaaattgtccaagaaattgattatggagacattcttcccagtggggatggaacctatcaggcgtgggcatcaattgagcttgatcctcagagcagcaacctttactcctgtcatgtggagcactgcggtgtccacatggttcttcaggtcccccaggaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatga

SEQ ID NO: 16999 - DNA, 7704 bp, Homo sapiens
ggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagagcccccactggtcagagtaaatcgcaaagaaacttttccaggggttacagctctcttctgcaaagctcatggcttttaccccccagaaatttacatgacatggatgaaaaacggggaagaaattgtccaagaaattgattatggagacattcttcccagtggggatggaacctatcaggcgtgggcatcaattgagcttgatcctcagagcagcaacctttactcctgtcatgtggagcactgcggtgtccacatggttcttcaggtcccccaggaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatgacacaacgcttccctacattctatttgtcaatgatgatttgcaactagttggagattctcagagcaggaaggaatcttttcaaccagagcaggaactgtcttctgcaatgccttggacttgagcctccagcctccacttgaacaccatgtgaagggaacctcagtacttcataaaatggcctttctcattcatctttcatgggaacatttattgtacaagcgctttgaatatcatgggcaccatgactgtgaccctacaggtaggattggatcactccatgagagtagccggcaggtttctacaatggcctgggaatggactgattatttttatacattttctggcctgagagaaagccaaagtcccctgctgttcacagcaaccctgcctgggagcttggaatcttggtaatctgcccggttggatctatggaggtagtctcaccctttttgtcttttgtgggaaattaagagaaataattatcagacatatcatcacctccagtggaactacagagacctggacccagctgcactattttaatgtaaaaataacagtatggccaggtgcagtggctcacgcctgtaatcccatcactttgagcagccaaggcgggcggatcacgaggtcaggagattaagaccatcctggccaatatggtgaaaccctgtctctactaaaatacaaaaaattagctgggcatggtgttgcgtgcctgtagtcccagctacttgggaggctgagacaggggaattgcttgaacccgggaggcagagattgcagtgagccgagatcacgccactgcactccagcctggcgacagagtgagactctatctcaaaataataataataataataataataataataataataataacagtatatttggtgtcaggagagggctcaattctcatttctgcctttcctgtgctggctcatggtagctgggcatgacttgccttcctacataggttgtcttcatacatatgcactgggaatcaataaaagcccatggtgagaatgaacatccccttaatgttccttactatccccaacccctgaggcctcacctactgccctgccatgtggagctacttgccctggggctgccagtcacacattcctcggtcctacttctctgaccccgtttgactctgcacctgagccctaatgcttacttcagtgacctgaactttgacaagtggcttttgtcctgcacctcaggtttgacctctgctctcccttgaccttgactgtgacatttgacctttggctttaatcattacagcctcagataaaggtaccttcagcccgggcacagtggctcacgcctgtaatcctagcactttgggaggctgaggcaggcggattccctgagctcaggagttcaagaccagcctgggcaacacggtgaaaccctgtctctactaaaatacaaataattagctgggcatggtggcatgtgcctatagtcccagctacttgggaggctaaggcaggagaatcacttgaatctataaggcagaggtggcagtgagccgagatcacaccactgcactccagcctgggcaacggagcaagactctgtctccaaaaaaaaaaagaaagataccctcagtgtgccaggcctctaagagctcacctgccaggcttcctccttgctccactgtcccatgtaattccatatatgaagctaccactgtacatctctcttttccggtgcctgttgagttgcatagaagcacagttgtgtttattttgtttttagggttgccatgggcaatttccgtgccacttttaagcagtgttgcactgtgaagagaatgtaggcaagtttatttctggaatggtttcttcttacaatcagaatagttaggatgtaatatatttttgggtgggcatttaaagtgaaaaggtacatatttacatagacacaggtgataatgtatctatgtaaatgccttttgattctgcaactgcaggatactctcatcaaagacacagataaaaagcctctgtgtttccaaggccttgccctacacctaacacataatatgtccaaatggatgaagaggaggcaaggacaaggatgtgatgacaaaacattctgttatgcacttgtagcatttatgtttcttcctgggggattttataatactaaaagaatcataatataaagagatgattaaaaaaaaaatactgccgggcacggtggctcatgcctgtaatcccagcattttgggaggccgaggtgggcagatcacctgaggtcgggagttcgagaccagcctgaccaacatggagaaaccctgtctctaccaaacatacaaaattagccggggatggtggcgcatgcctataatcccagctactcgggagtctgaggcagaagaaccgcttgaacccgggaggcagaggttgtggtgagccgagatcgcgccatcgcactctagcctgggcaacaagagtgaaactccatctcaaaaaaataaaaataaaataagtaagtaatacctaaaattctgcaaccttcattttactatagatggttgaagattatattacttcttaattgttttagccttgttattgcttcattacttcatggttgttgagtacagatgctcagtaatcataacctatgaaatatttgacaccatgatctaaacattaaaaacaaataactgtgctattgccacagctatgttttggctttgaattttctttactgaatattttggatcaagaacactagatgagaaacctgttcaactctgttcttttttttttttttaactccactgtatttattacctgtttttgttttttttgtttgtttgtttttgatgtgcatatagaccaagatgtggtaaatttaaatggcagatgtttttgatgtggtacatttaagggagagaaagcagtttaaagagcagggtgaaaaatccaacaagactccatcgagagtttctgagctctcccatcaggggccagtcctcctttcctctctcctcttactcccatgatttccaagttgtgatcctttccttatttctgaggaatgacttggtttctcctcttctttttttggcctgagagaagatgtttttgcacttgtagctatgaggaacagattgtccactagggaggccagctgatcattttctgccagagtcacacagagcagtcacaccttattttgaaaaccactgtctggggtctttgtcctcacatatgcaggtctagtgtccccacaaagtgatcagatggatatataaagtggagtgccaatgtattaatttactgtgagaaacacaattgctaagtgggtcagatatctgtctcagctggtcagtacaccttccagcaggaaaatctacataagaacaactaaatcacaatctgtagagtgcttgatgaccccagaattggtgcaaggggacacattcttgcttgttagcacctgctctctggagtttgctattttctcacacacagtgtattagttcacagaatgttctccaaggaggacagggggctttgcccatagccatgtgctgtgggcagcagagctaggaagaagcacaggcatctcccagcccaggtgtttcccacttaactgcattgcccttttcatcttttttttttccccaatagcttcaggacattcagtacattgtgctttttagaggttgatgattccactgcctgagctgccttcacctctctttctttggaaattgccatctttgagcattgtatgtctctgtaacatctctgcatctccttttcactctggcctccctttctccattgtccttctagcttctggttgccccaaaccccacagactgtgtaacaaaacccaaaacctattggtttaaaacaatacccattttattttctttcatagtttctatgggtcaggaatttggatatggcttgggtaagcagttctggcttctcatggagttggaggcaagtggtggctggaacagaaatggggcagccaggggtggtggccaggcatcagctacatctcctccatgtagtctcaggaactctccatgtaatctctctgtgtgggttgggcttcctcacaacatggtggcctcagggcagtcactgcttacatggcagctagcttccctcagagtgagtatcccaagagatcacagtcaaagtgcatagcatttatataatctaatcttggaagtcacaaaatgtcattcttgtgatactctcattggtgaagaagtcataaaatcctgctcaggttcaaaaagagggtgtatagaacccaacactcaataggaagattgtcagagttacattgtaagaagagcatgtagttgggagatatcattgtggccattttgggaaagatgcaacatgtcacaatgtcatgttctccatcgtctccccgttccaccttgtactggtttccaagggtagtcgtttaaaagtaccacaaaaactgggtggcttggaacaacagaaatttattgtttcacagttctggaggccagaagttcaaaatgaagtgttggcagaaacatgctgcctctaaagggactgggaaaggatctgttccaggcttccctcctatcttctggttgttccttgccttctggctgcgtaactctagtcttcatttggtgttctccctgcatgcatggctttgtgtccaaatttccttttttcatgaggccatcagtcatactggattagggacccactctactactgcaggatgacctcaccttcccaaattacatctgcaacaaccctatttccaaagaaggccacattctgaggtactgggggttataacttcaacatgaattttttggaggaaacaattcaactcctaacacatctctacccaacctctgtaggttccctcaatccaccaaaattttttggctccactggattatctagcagttaggaaaccaagatcattaaatgaattcaccgcaactacagtgagactgactaccttagcttacctctgtgaaaggagttaagccaaaggaatctgtggaattttggagagtttgggagcatttgggggcaggaggcaaatgttcttcctttaaatcacaacacttagttctcttccatttataagactcacccctccatcccaacccctgcaccacaggacaaggaagtgttcttggtcttcaactttcatccctgatggtgaaagcagttgctcctgacctatttgcccaccagcttctcctctggagcctgaggcttctgatgcctgcctggctggttctcagtaagaaggtcaagttcaaccagaggggagatgctgatgcctttcagtacttaaatatgagttcagaccctggggcctggacataagatttggggtcccctggatataagatttctgaaaacactcagactgtggagacccctgctgagggagaagccccaaactgtggcttcaggggaatgcaccaaggctctcattgaggccaccttctccaacaagctcccctcctgcttccccatggctggcatggctgaggaaaaaggacactgagcacagcccgtgcatgagcggcttgccatgcaacaggataaaacccataatgccactcagcaagccttggttgtaaatctagtttgattacatttgtaatcaaatgatggccatttgttctgtttctggtttgtgaaccaactgaagacataagcagggcctcagctaacccacaaatagcacatgtgtgcaaactggaaaaatgaacccttcttctgggaggacgccagcccaggccaggtcacccggcttggccagcagaacacagagtagattttggtcccgtttgttccccagtggggtatctatccttgtgcagggcacaagcctacatggtggctctggtcatatcattagaaaatagacagaaatgggctgcacaccagaatgaatgaattgaattgaaagggaggagtgatggtggaaaaaaaaacaagtcaattcatttagactggtagaaccagaaccactgtgtagtacatccaaacggttaaaattccctggaagatgttacataatcctatcatggtgtttatttatggaaatctattttaaaaattttatgtaatactgcacagtctgtttgcatgatgccttgtacgtagtagcaactcagtaaatactttttgaatgaactagtatagtattttaattagctagtcttcatgtactggtacaaaagaacagtgtcatcttacagctgaagtcatagaggggaaatatcccactcaagatcatataacattccaggtactcaggatgaatggtttgaggactggtctgaattcttcaaaggtttcagctgtattaacattctccatctaataaactttatcttgtcattgca

SEQ ID NO: 17000 - DNA, 1046 bp, Homo sapiens
ggccttgtgtgtcaccaagaggttctcagaagggacctgtcagtttttggttaaaagaacccggaaagagaaggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatgacacaacgcttccctacattctatttgtcaatgatgatttgcaactagttggagattctcagagcag

SEQ ID NO: 17001 - DNA, 2599 bp, Homo sapiens
acccaggcactgtgaccatcccccctgccatgtgggaactgcgatcagcctccttttggagggccatattcgctgagttctttgccaccctcttctatgtcttctttgggctggggtcctcactgcgctgggctcctggacccctgcatgttctgcaggtggctatggcatttggcttggccctggctacactggtgcagtctgtgggccacatcagtggagcccacgtcaatcctgcagtcacttttgctttccttgtgggctcccagatgtccctgctccgtgccttctgctatatggcagcccagctcctgggagctgtggctggggccgctgtgctgtatagcgttaccccacctgctgtccgaggaaacctagcactcaacacgttgcaccctgcggtgagcgtgggccaggcaaccacagtggagatcttcctgacgctccagttcgtgctctgcatctttgccacatacgacgagaggcggaatggccaactgggctccgtggccctggccgttggcttctcccttgccctggggcacctctttgggatgtattatactggtgcaggcatgaatcctgcccgctcctttgctcctgccattctcactgggaacttcactaaccactgggtgtactgggtaggcccaatcattggagggggtctgggcagcctcctgtacgactttcttctcttcccccggctcaagagtatttctgagagactgtctgtcctcaagggtgccaaacccgatgtctccaatggacaaccagaggtcacaggggaacctgttgaactgaacacccaggccctgtagaagctccagctgaatagagggagtagaaagcttctgagtttacgtggaggggtttagccagcccctagatgaagaaagagactgtggggagggtcatgtacttctttattttttaacttatgtatgtggttgttttttttttttttttccttttgctgtgtgaaatctttcaagttgcattcatgagctggttggtgcaaacttcccttcctccccatcccaccacccttcgccgtgtgtgctgattgtgcatatgaatgtgagtgtggctgtgtctgagttttggggcatgagagctaaggaagcaaaaagaggtgccatcctatacctcccttcctcgacccagtatggtgagtactgggtaaccgacaccttaagtttctggcctttaccctgctgccagtcaagtgtgtggctcttgatttctgagggaacagagaagcagggagttactcctcacacgaggcagatggagagaagtggaggagacaaggcttccaagggttaggagaagggactcaagggaggtgggtggtgaaaacggagtattagccccagatcaggatgtaggtgtaccgaagaattggggggaagttaatgggaatatatagcctacttatcttagggatgcttgccccagggacttgggtggggaagtagctctgagaaaagtgaacactaggatttagctgttctgtaaagccacgtaaacctgtctacatccgctggctggttgtgttcattctgacataatggatctcttcagaggtcctgggccaaagagcttccaacctaaatagagcttgggcaagcctagaatctagaaaaattaagcagcttaactggtcagcctgacatccactgttgtggctgcctggcagatggtatttaagccccacaattgttccctaaggccaacacaggaaatctgattcctggagcaaataaatgaacgggtggtagtagggggcatgaggggagaggctttgactctgttctaatttatttagagcaaatcaaaacactcctcaaatggcatctttctgcttttatcactagttccgtgttttttttcttgttttgtgtctgtgtattttcatttctctgtcatccgtcctttcatcttgaagcaaatctcttctaactccctcataccccagaaattgattccttctattcaaatgcttaataattcaggagattattatttgtttgagccctatcttctttttttttttgagagggggtcttactatgttgaccaggttggagtgcaatggatattcacaggcacgatcatcgcacactacagtctagaaatcctgggctcaagcgatcttcctgcttcagcctccccagtagctgggattacagggggccagagcacagccctattttcttttccttttggcaagatcatctcagcagaggccagaagagaccctcaactgttcaatgaatatttacggttgctttcttccttttatgagcctcttgcatactttgaaagctttaaatttatacctataatacaacggacatcccctatcccagaagaccattcctccctgtacttcagctctttacttcctcccaaataaaacctaacttttctaactaactatttaagacttggaatagtccgcttgactagaagaaggggaagaatgtttgtaaattcacctctaatcggactttgattctactataattcagcagaaaattcatagcgctgtgatttttagatcgacctcacataaaacagtccctgcactcgc

SEQ ID NO: 17002 - DNA, 2865 bp, Homo sapiens
acccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaa

SEQ ID NO: 17003 - DNA, 2833 bp, Homo sapiens
ttccccatctgaggcgtttgttgcagctacctgcacttctagatgctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggc

SEQ ID NO: 17004 - DNA, 1098 bp, Homo sapiens
aaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcgg

SEQ ID NO: 17005 - DNA, 2848 bp, Homo sapiens
cacaccggaggggcggcgtgcgccggcgtgcgccggcgtgacgcggctacgcgggatgggccgggccagggccaaggccgaggcggcagcggctgcgagaggcggcggcacgacgacggtccctcagcccagccaccatgagcaccaagcagatcacttgcaggtattttatgcatggtgtgtgtcgggaaggaagtcagtgcctattctcacatgacttggcaaacagcaaaccgtccaccatctgcaagtactaccagaagggctactgtgcctatggaactcggtgcagatatgaccacacgaggccctctgctgcagctggaggtgctgtgggcaccatggcccacagtgtgccctccccagctttccacagtcctcaccctccttccgaggtcactgcatccattgtgaaaactaactcacatgaacccggaaagcgtgaaaagagaacattggttcttagagaccgaaatctctctggcatggctgaaaggaagacccagccgagcatggtgagtaatccaggcagctgcagcgacccccagcccagccccgagatgaagccgcattcctacctggatgccatcaggagtggccttgatgacgtggaggccagcagctcctacagcaacgagcagcagctgtgcccctacgcagctgctggggagtgccggtttggggatgcctgtgtctacctgcacggggaggtgtgtgaaatctgtaggctgcaagtcttgcacccattcgacccagagcagaggaaggctcatgaaaagatctgcatgttgacgttcgaacacgagatggaaaaggcctttgccttccaggcaagccaggacaaagtgtgcagtatctgcatggaagtgatcctggagaaggcctctgcttctgagaggagatttgggattctctccaattgcaatcacacgtactgtttgtcctgcatccggcagtggcggtgtgccaaacagtttgaaaacccaatcattaagtcttgtccagaatgccgtgtgatatcagagtttgtaattccaagtgtgtattgggtggaagatcagaataaaaagaacgagttgattgaagctttcaaacaggggatggggaaaaaagcctgtaaatactttgagcaaggcaaggggacctgcccatttggaagcaaatgtctttatcgccatgcttaccccgatgggcggctagcagagcctgagaaacctcggaaacagctcagttctcaaggcactgtgaggttctttaattcagtgcggctctgggatttcatcgagaaccgagaaagccggcatgtccccaacaatgaagatgtcgacatgacagagctcggggacctcttcatgcacctttctggagtggaatcatcagaaccctaaagagtagatggttgccctgcatcttgggctccatcggccgaaactttcccaagccagggtgtgcggagcttccctgtactgcagccaaggtgacgtgtgacttggatttgagtggagttgggcttagccttagtctcattcaatctccattattacagccatggggaagagtgaaagatataaagtaacctaattaaatgtatggaattgctatttttatagctgatatagttacacctcaagcccctcaggggtaacaactaacaaacacccaaactgtttggattgattgctttaaaaaacaaacctggctcttacctttgatcttttcttccccagaaatagtaaacttgcagctgcccctaatgcagcatatttttcttaccaaaggagtcttcagccctataaaaggattcctctatagtgtatttctctagtgtatttagtgtgtcgtcaaaattttgatttatacagagctttcaagaacacacaatgcaaagtgagcgcagcatagctgttaacaaacatacaacttttttctagggctttaagggtggtcatttttttcaagttctctcaagtgtcccaaatcagggtagcaatcttgttgccacatgtgcagcaaacaaagtggaagtatagatcttcttctcccttagggaggctcttgaaggagcaggaggtacagtactgggtagcagtctggccctcctgtcgtctggttggtgttggggcctccagccagggccctctaggggaaccaagcctctgctctcacctgtgggttcttgcccatcagggtaattgtattgagaactcaaatatacgtgcacttacatgtgtggttcgtactcaagtgatctattatctagctgcaaagcctggctttgatttgaaattttgtaaaaatttcatggcacccaaggtttctgattctgacccagcagtggtcctgaagagagctgatggcaagtcttgtagtcattttgattttaattgaagggtgagcataaccttgtgaaccagcactagcttgttccaagctggaatttatctaatctatttttgtgtttaaaaaagctgtacctaccaaataaataaatagtttataaaatgtattacttaaggtattagctgagtttagagtactttctgcttaattaatttttatacttaactcttcagtagaggtttacaaagagtacaaaggttaaattacaaattcattcccagcctaggctctgggcacatttcctgttcttgaattctgctcctgaagagggtgaacaaatggggcattcaagttgtgagctcagaattactttaaaaggaggtaacagccagccattacacctaaatttaatttattttattaaaataacataattgagggaccatcagataactgtattttgtcaggtgcaataaaaacaaaattaaaacccaaatcatcaagaaaa

SEQ ID NO: 17006 - DNA, 2711 bp, Homo sapiens
tgtttcagaatctataggattatattttttttaaggcagacagatacgaaaatacaacgaagcgtgcatgaccgaaaccagaagagattaaagtaaaacctcattctcctgaggaaatcgtgtgagaagggacttagggactgccggaacacagcgaagcagaggcagaaggcagacaaaaggggctgggttggtccccgcctgtgtgaacgaaaaaatatgtcagattggaaaattgcggtaaaaaccaggcagagcacgtacgttgcccccacaggaagtgtccgccatgctgcctgtgcccggaagtaggtaggaacacacagtcagagggacccaaaagcaggggggaaggaaaaagagatgcacacttcccccagagaagcctccgagcgcggccgccattccgggcctcaagcccataaagaaaaaataccggagaggttctggcaccatttcggggtgccaaagcagccatggaagagcctgcagctccctcagaagcccacgaggcagccggggcccaggcaggtgctgaggcagcaagggagggtgtgtctgggccggaccttcccgtctgtgagccctccggggaatctgctgctccagattcagccctgccacatgcggcaaggggctgggcccccttccctgtagctccagtccctgcccacctccgcagaggaggcctgaggcctgccccagcctcaggaggaggagcctggcccagtccgttgccaagccgaagcagcggcatttggacaaagcagatcatctgcaggtattatatacatgggcagtgcaaggagggggagaactgtcgctattcgcacgacctttctggtcggaagatggccactgagggtggcgtttcgccgcctggggcctctgcaggtggaggccctagcacggctgcgcacatcgagcccccgactcaggaagtggcggaagcccccccggctgcatcctccctttccttgcctgtgattggctcggctgctgaaaggggtttctttgaagccgagagagacaatgcagaccgtggagctgctggaggagcaggtgtagaaagctgggcggatgccattgagtttgttccagggcagccctaccggggccgctgggttgcatctgcccccgaggctcctctacagagctcagagactgagaggaagcagatggctgtgggcagtgggttgcggttttgctattatgcttccaggggagtttgctttcgtggggagagctgtatgtacctccatggagacatatgcgacatgtgtgggctgcagaccttgcaccccatggatgctgcccagagggaagaacatatgagggcctgcattgaagcacacgagaaagatatggaactctcgtttgctgtgcagcgtggtatggacaaggtgtgtggcatctgcatggaggttgtctatgagaaggccaaccccaatgaccgccgctttggcattctttccaattgcaaccattccttctgtattaggtgtatccgcaggtggagaagtgccagacagtttgagaacaggatcgtcaagtcttgcccacagtgcagggtcacctctgaattggtcattcccagtgagttctgggtggaggaggaggaagagaagcagaaacttattcagcaatacaaggaggcaatgagcaacaaggcctgcaggtattttgcggaaggcaggggtaactgcccatttggagacacatgcttttacaagcatgaataccctgagggctggggagatgagcctcctgggccaggtggtgggtcattcagcgcatactggcatcaacttgtggagcctgtgcgaatgggagagggcaacatgctctataaaagcattaagaaggagcttgtcgtgcttcggctggccagtctgttgtttaagcggtttctttcactgagagatgagttacccttctctgaggaccagtgggacttgcttcattatgagctggaagaatatttcaatttgattctgtagcatcgtgctgtggcatgtggtctagtctgctgaggttctgtcgtctgctattgcctgttttccctgtgttgacactcttactgctttcaggggctgttgaggcagtgcttctgttttcttgtctattctgcatatctttccccctaggattatggtgattatctgtgttaaaaaataagtccttaaagttactgttttggtgaaattaatattaatgtcagcttatggcttttttttgtcatctctgttgtcaacaggattaactcagttctagtgtagtgtttactgaatttccacacttattttgaagaccctcaagagtaaatgtggcagagtgaaaggagaagttttaattgaactagtagctttgtgctataatagccttaacaaatggacccttgcagggctttgcagctgctcatctgtttgtttacagtttgttctttccctccttccccttcaagtgcacttgttaaactgtgatgaacttgtgattttgtgttttacttgaccaaaaccaagtgtatatgtttacatgtttttatcctgtttagcttgacatgaaataatttatatttggaaatatatatttaagaattatatatataaaaatatatatgtataagagttatgtatttgaaaaaaatatataaaagaatatacatcacaatataatatttatgtttatgtaataaagtaaatacagagctg

SEQ ID NO: 17007 - DNA, 1108 bp, Homo sapiens
cccgcgcgcgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttatcttcgggggcctggtgtggatcctggtggcctcctccctggtgccctggcccctggtccagggctgggtgatgttcgtgtctgtgttctgcttcgtggccaccaccaccttgatcatcctgtacataattggagcccacggtggagagacttcctgggtcaccttggacgcagcctaccactgcaccgctgccctcttttacctcagcgcctcagtcctggaggccctggccaccatcacgatgcaagacggcttcacctacaggcactaccatgaaaacattgctgccgtggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaa

SEQ ID NO: 17008 - DNA, 705 bp, Homo sapiens
atggcccccgcagcggcgacggggggcagcaccctgcccagtggcttctcggtcttcaccaccttgcccgacttgctcttcatctttgagtttgtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaa

SEQ ID NO: 17009 - DNA, 873 bp, Homo sapiens
atggcccccgcagcggcgacggggggcagcaccctgcccagtggcttctcggtcttcaccaccttgcccgacttgctcttcatctttgagtttatcttcgggggcctggtgtggatcctggtggcctcctccctggtgccctggcccctggtccagggctgggtgatgttcgtgtctgtgttctgcttcgtggccaccaccaccttgatcatcctgtacataattggagcccacggtggagagacttcctgggtcaccttggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaa

SEQ ID NO: 17010 - DNA, 831 bp, Homo sapiens
atggcccccgcagcggcgacggggggcagcaccctgcccagtggcttctcggtcttcaccaccttgcccgacttgctcttcatctttgagtttgacgcagcctaccactgcaccgctgccctcttttacctcagcgcctcagtcctggaggccctggccaccatcacgatgcaagacggcttcacctacaggcactaccatgaaaacattgctgccgtggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaa

SEQ ID NO: 17011 - DNA, 3061 bp, Homo sapiens
actagaggcagcagccagccagcccagcccttctctggtgcctgccggtgtggtcctctcccagagactggggggccttcatctgccccatgaggaaaagaggagtggaggaccatggaaagggatccagaaaaagaaggaaacaccaagtcccaggggcatgagctggaagggagggctgctcctcccaggggaggctggggactgagagctgtccccaagagtggaaaaggagggagctgggcaagacccagcattgttagtaaccagctctgtggtcttgacttgacctcactgattctcagtctcctcacttggaaaagggcaaaacagccacgtgcaggccgtggtgggcacccgggctgtctgcagatagcttggctcattgttggtcctcagtacgcagccctcgtagccaagcagcttgggcctacactctgggcccaggggagtggctgtcgctggcatcccctggaataacatgctccgggggtcaaagattccttagctggaaaggtctaggaggagactcccgctctgctccctcctgcaccagcgctgtgccccccgccggccaggcagagccatccgatgccgctgggccgcccactgaggatctgctggctgcagcgagtggaaggacctgctcggctggaacgttttttttttttttccctcccaggcgacgtccgatgggtgtgtcgggcaggaggtgatatttgacaggctgcgcgcgggcgagctgccgcggagcacccggcaggggctgacagcatggcctcgcccgacccgcccgccaccagctacgccccgtccgacgtgccctcgggggtcgcgctgttcctcaccatccctttcgccttcttcctgcccgagctgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccgtgcccggctaatttagttgtatttttagtagagatggggtttcaccgtattagccaggatggtctcgatctcctgacctcgtgatccgcccgcctcggcctcccaaagtgctgggattacaggcgtgagccaccgcgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatttgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgctcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatacttttttttttttttttttttttgcaacctgataccttgaaaagcttctatgtgtctctccttttgttgcctggcagctgtctaggatgatcactgattactatttactaagtagccacatgcaaataaaagttgtttggtaaaaagga

SEQ ID NO: 17012 - DNA, 1650 bp, Homo sapiens
gcgcgtgggggtgatgtcgctaaggggtgattctcccctccctagagttacacacgctatctctcccgccaattgccgggctccatcaggcaggtcctttcctcctgagcccaaaccatccgtttgttgtcgtcctccaatcacaggggctcatcctcagggactactttgcaatcggcgcagagcgcagtgagaagagcttgaaaaaaacctctggtatcgggaagtgtagttcaacacttgaaggaaatgctttggagattgcgccacaaccagggcagcgtaaactacagttcccagagagcgccgcgtcgggagcggagccttttctcgctaacaccgctcgccctctccgagtcagttccgcggtagaggtgacctgactctctgaggctcattttgcagttgttgaaattgtccccgcagttttcaatcatgtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctgctgtcatcaaggctcgaaaactatccagtgccatgtctgctgcaaaagccatctgtgaccacgtcagggacatctggtttggaaccccagagggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaaaacaacacattttaaagattacgtgcttcttggtacaggtttgtgaatgacagtttatcgtcatgctgttagtgtgcattctaaataaatatatattcaaatgaaa

SEQ ID NO: 17013 - DNA, 1212 bp, Homo sapiens
atgtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctgctgtcatcaaggctcgaaaactatccagtgccatgtctgctgcaaaagccatctgtgaccacgtcagggacatctggtttggaaccccagagggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaaaacaacacattttaaagattacgtgcttcttggtacaggtttgtgaatgacagtttatcgtcatgctgttagtgtgcattctaaataaatatatattcaaatg

SEQ ID NO: 17014 - DNA, 1340 bp, Homo sapiens
cttgcggggtatggggcgctcttaggaggactctggagaagtagttgtcctgggagaggagcgatcttaatcctgctgcatgacgggaggacaaaatgcgacgctgcagctattttccaaaggacgttacggtgtttgataaggacgataagtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctgctgtcatcaaggctcgaaaactatccagtgccatgtctgctgcaaaagccatctgtgaccacgtcagggacatctggtttggaaccccagagggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaaaacaacacattttaaagattacgtgcttcttggtacaggtttgtgaatgacagtttatcgtcatgctgttagtgtgcattct

SEQ ID NO: 17015 - DNA, 1172 bp, Homo sapiens
aaaatgcgacgctgcagctattttccaaaggacgttacggtgtttgataaggacgataagtctgaaccaatcagagtccttgtgactggagcagctggtcaaattgcatattcactgctgtacagtattggaaatggatctgtctttggtaaagatcagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctgctgtcatcaaggctcgaaaactatccagtgccatgtctgctgcaaaagccatctgtgaccacgtcagggacatctggtttggaaccccagagggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaaaacaacacattttaaagattacgtgcttcttggtacaggtttgtgaatgacagtttatcgtcatgctgttagtgtgcattctaaataaatatatattcaaatg

SEQ ID NO: 17016 - DNA, 2209 bp, Homo sapiens
agagagcaggcgctgggcagtgtggaggtcgttggagtcacttccccgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaa

SEQ ID NO: 17017 - DNA, 3984 bp, Homo sapiens
gcaggcgcggacaggtaatccccagcgggctgcagggccaccaccctctgtccgacccagccggagcccgacctgcgaggctggccgggcatgtcccctcggcgccctgtgctaccagggccaatctccgcccggagaccggtccctgacgccgggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcatgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacagaaagattgcaattatttgtttttctactttgaagctatgggagcgatggtaatttcaatcttgagcaggatatctttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagctttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatctgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggacacttttaaactctgaataggcattaaaaaaaatatggctaa

SEQ ID NO: 17018 - DNA, 3830 bp, Homo sapiens
ggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcatgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacagaaagattgcaattatttgtttttctactttgaagctatgggagcgatggtaatttcaatcttgagcaggatatctttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagctttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatctgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggacacttttaaactctgaataggcattaaaaaaaatatggctaa

SEQ ID NO: 17019 - DNA, 1788 bp, Homo sapiens
acaagggagcgaacgagggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccagccctgctttttagtggaagtggaaagacctaattagggagagaggttggttaagttgtagaatatgaagaccatttaaagtaccaagctgccttctgttcctctaaaaactgcccttacacatgggaggagttaactgttggtcagggctatgttcccacctatgtggggactggctaaaggcaggaggttcaggggaacagagcttgaccatcttaaggaacccatccccccaaaaatgaccagctactttgcccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgttttt

SEQ ID NO: 17020 - DNA, 2459 bp, Homo sapiens
agggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcgtcaacaggtgaagatggctgttatttccctctcagcacaccagtttcccacgttatgaatccaactgcagccgttgcaggacagatagaaacatgttacacacaagcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcatgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagt

SEQ ID NO: 17021 - DNA, 6626 bp, Homo sapiens
gtgggattccggggccgcctgggcgctgcacccgccacttccgcatcgaaccgccgcttcaaccgaactcactccctctgcgcgcgctccatctggtgcccgactgctgggccggcgcctgggagaagccacgccctttcccgcgcctgacagccaatgagcgggcgcctcccggcggggtggtgggtaattaatgagggccgggcgctgattggctgcagcgtcgtggccgggggcagggcggcggggtaggttgttcctgaggtgggaggcggtacccgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagatttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacacggaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgacactctg

SEQ ID NO: 17022 - DNA, 1089 bp, Homo sapiens
gcggggctggaggactaggcacctctgcacgtcctgccccgccggaagtggaggccgcgggctctgagcgggtgaggcgcgcgggaacaccggcgccgggattcggatgggggcgggtgggggacgctgcagctggggccatttgaggggagcccatggggcctgaaaggcatctgtcaggcgcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccagaacatgtagagctggtgaaaaggacaatggctggagtaagcctgcctgcgccaggggttcctgcctgggctcgggagatatcggatgcccagtgggaagatgtggtacagaaagccctccaagcccggcaggcatcccctgcctggaagtgaccacagtgagagctgccttatattcctacattccaggccagaaccagcacaggactgaacacatccctggttgtaatgtccatttccatcttccccgtctccctttccacatcaaggcacatcagacttctcagagacccactttattcagttctgtacatatggggacatcggtccaagcccaacccaccttagcatgtatcactctgtggagaataaagcaccctatgtacacagccaaaagccgcactgcctgcgcccctggaacctgggtccggccttcctcagcccctggcccctccaaggtacctataagggacaagagaaggcctgcccagcatagcacaaacaaggaaataaataggtgttggcagga

SEQ ID NO: 17023 - DNA, 3371 bp, Homo sapiens
agtgcggccgccgccgccacagctgcagtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaaggacttggcctttaccctggaagagagacagcaattgaacattcatggattgttgccaccttccttcaacagtcaggagatccaggttcttagagtagtaaaaaatttcgagcatctgaactctgactttgacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttcaaaaaaaaaaagctagaaatgaatctaggcgtaggtgaacttttgctaagcagaaataacactactttgttgcctagagaaagataacttctcaagtatttttattccagtcctagatcatatatgttcttttgtgcaacggaattctaacagttctaagagaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcctgaggttggcaccttcagttcagcacagcctgagcagtgagaaggtctgaaaggagagtatatagttaagatccttgagaaagggctgcctgaggaactgacctcttaaagatctcaggatctttaagacaacaagttaggttcctactggagttacctgccagaatggcctcttaattaactcaggtaatgaagagctaactgtgttataatcatcttgcttttgcctgaatttggagaaagtattataattaagttcccagtatcagaaatgtccttacataagattaaaatatcttgatgactaataccattctatgagaaagagtagttatatgcccagactgtattaatttactttagaaactaatgtttgaagtaatggaaaaaattttaaattataaagctaaggtgcaataacatttgctacttatttatagaattatttgaagaattttgtttttgaagtaatgctttaaggagtataagatattcaagataaattatactataaaatgattttattgaaagttgaaggttacacaaattgttttaggtatgagcagaagaggttaaggtatttctaaaggtaacatatagtcaagagtttcctcaaaatagttatttggagaagaatcagaatgtctgtgtatttcttgtctgtttctatgttgtcttatagctctgactaaatgtgtttacctatgcaaaagatttattaaagcatagaaaaggtgaatgaataaaaatataaaataattgtcctttttcttaaaa

SEQ ID NO: 17024 - DNA, 2234 bp, Homo sapiens
gtaaaaggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttcaaaaaaaaaaagctagaaatgaatctaggcgtaggtgaacttttgctaagcagaaataacactactttgttgcctagagaaagataacttctcaagtatttttattccagtcctagatcatatatgttcttttgtgcaacggaattctaacagttctaagagaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcctgaggttggcaccttcagttcagcacagcctgagcagtgagaaggtctgaaaggagagtatatagttaagatccttgagaaagggctgcctgaggaactgacctcttaaagatctcaggatctttaagacaacaagttaggttcctactggagttacctgccagaatggcctcttaattaactcaggtaatgaagagctaactgtgttataatcatcttgcttttgcctgaatttggagaaagtattataattaagttcccagtatcagaaatgtccttacataagattaaaatatcttgatgactaataccattctatgagaaagagtagttatatgcccagactgtattaatttactttagaaactaatgtttgaagtaatggaaaaaattttaaattataaagctaaggtgcaataacatttgctacttatttatagaattatttgaagaattttgtttttgaagtaatgctttaaggagtataagatattcaagataaattatactataaaatgattttattgaaagttgaaggttacacaaattgttttaggtatgagcagaagaggttaaggtatttctaaaggtaacatatagtcaagagtttcctcaaaatagttatttggagaagaatcagaatgtctgtgtatttcttgtctgtttctatgttgtcttatagctctgactaaatgtgtttacctatgcaaaagatttattaaagcatagaaaaggtgaatgaataaaaatataaaataattgtcctttttcttaaaa

SEQ ID NO: 17025 - DNA, 1872 bp, Homo sapiens
agtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactc

SEQ ID NO: 17026 - DNA, 1928 bp, Homo sapiens
ctttcccagtgcggccgccgccgccacagctgcagtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctg

SEQ ID NO: 17027 - DNA, 3164 bp, Homo sapiens
cccgtccgtctccaccgtgggccacgccttccgggccccgcggctggccggctcctcgcgccctcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaacacaaaatcttattccttggagcaggagaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactataattggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagagggcaggtgtttgtttgccagtggcagtccatttgggccagtgaaacttacagatgggcgagtctttacaccaggtcaaggaaacaatgtttatatttttccaggtgtggctttagctgttattctctgtaacacccggcatattagtgacagtgttttcctagaagctgcaaaggccctgacaagccaattgacagatgaagagctagcccaagggagactttacccaccgcttgctaatattcaggaagtttctattaacattgctattaaagttacagaatacctatatgctaataaaatggctttccgatacccagaacctgaagacaaggccaaatatgttaaagaaagaacatggcggagtgaatatgattccctgctgccagatgtgtatgaatggccagaatctgcatcaagccctcctgtgataacagaatagaagcactcccctgataaatactttctgtgctccagggaaccccttttttcagacaagaagagataatgtcttcagttttatggtgttttctgtgttttgttctccctgaccactttggttgatgtattttttccatgcgtctccacatctgttggggtagacgtgttgattgattgcattgcccaccagcaccctacagtcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctactaaaatagaaatttacttttatggatagaagtacagaattttgagaagaaactaaattttcaccaaattttaaggaaaaattgtcattatctaaaaatgttcttatatatctgcttcatcttaccttcatactctgaaattccctatagcagacagagctagggaaatattaaaaatttaccctatttattttctggaactaaatcaagccttaactataacattatgagagtaatgggaactactgctggctttaagtaaataaaagtcattgttttcaacagtgtataaaaatcatagtgtaacctttttatttaataaatatcttacatttaattgcttcagttatgctatcttattgcccaactagaaatttagatttgcttatgaaaaacacatatttttgttacttctagatgattctaggagggagtataagatacctaatcatatgggaacatcacgtgactttttaaatctaaattagtcatgcttcacatcaaaatgagtcatatttaactggagaaactatgcccttattccagaactgatgctctttattgcttgagataattttggaatgttactatgatactgtttctttgaatatcattagtagtgacaactctttctccattgaaggcagacttaatttttttaaaccaccaacattaatttagagctaaatggggatgaataaggttggtgttcatctgggaaatgccttttttaatcccagtaaaatgggtaataatggctatccagaa

SEQ ID NO: 17028 - DNA, 4450 bp, Homo sapiens
accgtgggccacgccttccgggccccgcggctggccggctcctcgcgccctcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaacacaaaatcttattccttggagcaggagaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactataattggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagagggcaggtgtttgtttgccagtggcagtccatttgggccagtgaaacttacagatgggcgagtctttacaccaggtcaaggaaacaatgtttatatttttccaggttacagaatacctatatgctaataaaatggctttccgatacccagaacctgaagacaaggccaaatatgttaaagaaagaacatggcggagtgaatatgattccctgctgccagatgtgtatgaatggccagaatctgcatcaagccctcctgtgataacagaatagaagcactcccctgataaatactttctgtgctccagggaaccccttttttcagacaagaagagataatgtcttcagttttatggtgttttctgtgttttgttctccctgaccactttggttgatgtattttttccatgcgtctccacatctgttggggtagacgtgttgattgattgcattgcccaccagcaccctacagtcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctactaaaatagaaatttacttttatggatagaagtacagaattttgagaagaaactaaattttcaccaaattttaaggaaaaattgtcattatctaaaaatgttcttatatatctgcttcatcttaccttcatactctgaaattccctatagcagacagagctagggaaatattaaaaatttaccctatttattttctggaactaaatcaagccttaactataacattatgagagtaatgggaactactgctggctttaagtaaataaaagtcattgttttcaacagtgtataaaaatcatagtgtaacctttttatttaataaatatcttacatttaattgcttcagttatgctatcttattgcccaactagaaatttagatttgcttatgaaaaacacatatttttgttacttctagatgattctaggagggagtataagatacctaatcatatgggaacatcacgtgactttttaaatctaaattagtcatgcttcacatcaaaatgagtcatatttaactggagaaactatgcccttattccagaactgatgctctttattgcttgagataattttggaatgttactatgatactgtttctttgaatatcattagtagtgacaactctttctccattgaaggcagacttaatttttttaaaccaccaacattaatttagagctaaatggggatgaataaggttggtgttcatctgggaaatgccttttttaatcccagtaaaatgggtaataatggctatccagaacagttttcttgtgtggcttgcatattgaagaattctaaaggaaaatatatctgcctaccatgcttgctcttagggaagaaaacttaaatgctcattctaggatagtaacaacaacagataattcatcgataatatgagcatgcacagtatttgatattgctctgtaggaaaaaagagacttcatttttttcatcttctgcctatgaatacaaattgattctttttttttttttttttttttgagacagagtctcactctgttaccaggctggagtgcagtggtgtgatctcagctcactgcaacctctgcctcccaggttcaagcagttctcctgcctcagcctcccaagtagctgggactacaggtacacgccaccacgcccagctaatttttgtatttttagtagagacgggatttcaccatgttggccaggagggtctcgatttcctgacctcgcgatccgcccacctcagccttccaaagtgctgggattacaggcgtgagccaccgcacccagccaattttttttttttttttttttgagacagagtctcgcttttgtcgcccagtctggagtgtagtggcatgatctctgcaacctctgcctcctcggttcaggcgattcttctgccttagcctcccaagtagctgggattacaggcaccggccaccacacccagctaatttttgtatttttagtagagatggggtttcaccatgttggccaggctggtctcaaaatcctgacttcaggtgatccacccactttggcctcccaaagtgctgggattacaggcgtgagccaccacacctggtccaattcatcataattctgaatataatttaataattttaaaatggtcgcaatggcattgccatttggagtatgggaaaatgcagttggttaattcattgaacagattagtaaagtcagaagtctttttcataacatacggtcacaattcctttcttttaattaaagacaaaaggtttatgggttttggtttgtttgttttagatatggggttttgctatgtcacccttgctggagggcggtggctgttcacaggcgtgggtcatagagcactgcagcctggaactcctgggttcaagctctcctcctgcctcagcctcctgagcagcttggactaaaggtgtgcaccaccgcacctggctgagaggcttctgtttttcatgttccctttatcaaaacaaaatcacgcctaaacatactctctgtgtgaaatcttgattttagttcaacctaagaaatataataaatataaacctgtttcttgcttagtgtttattgaaggcaggaacgtatgctgaattaaagtaattttactacgaagtttgcttattaagtatgcctggtacagtcttcatggaagttattaagtattttaaggaaaaaaataggctaaatggcatatagcctgcttaaataaaataattctattttttt

SEQ ID NO: 17029 - DNA, 780 bp, Homo sapiens
atggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaagatgacttctccagaggcccaaagaggtcacaacttttcttcaagtga

SEQ ID NO: 17030 - DNA, 2088 bp, Homo sapiens
gctcctcaccccgcctgctccgcagcgggaccgcgtagacctcagctccccgagcagcgcaggtgggccagggaaggagaggaccgaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctgaggcagtctcagaggctagtatggggctagatgaagcccagagtaacacccacaatataaatgggttccaaaatggcccaagtgaatccttgtcgctgtgttttttcttttaaactttctggtgtgagaggagatgccaaggcatacagtgaataaaagccttgtctctgaa

SEQ ID NO: 17031 - DNA, 2154 bp, Homo sapiens
caccggatctgcttccagggcttggtttcgctttgcctggctcttggctaggcctggcgccccgcgcggagccgagcaggtggcagccgaggagtggcgggggctggaacatttaaccctttgggagcacctgccctctcccagagggcgcgtccccggatcaggcccggtgccccgcagcgcgcgtgggtcctggctggctggaaggaggccctgaccttgctttctctcccgtgccaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctgaggcagtctcagaggctagtatggggctagatgaagcccagagtaacacccacaatataaatgggttccaaaatggcccaagtgaa

SEQ ID NO: 17032 - DNA, 2069 bp, Homo sapiens
aaacgcaaatccccctctgtgcatttagtcttgccaagatggagagtctcaggcgggcattctgagctgcttcttgtcactggggaaaaccacgtgcacgcagtgctgaggcgccccacgcgcgtcctcaggggaagccaggcactgagaacaaaggttgtgggaccgctctttgaggaactcaccagctccgcgagctcgcggccgccagcgcggtccacccattggcgggagaggactcacagaccgcagctcctcaccccgcctgctccgcagcgggaccgcgtagacctcagctccccgagcagcgcaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacac

SEQ ID NO: 17033 - DNA, 1776 bp, Homo sapiens
aaacgcaaatccccctctgtgcatttagtcttgccaagatggagagtctcaggcgggcattctgagctgcttcttgtcactggggaaaaccacgtgcacgcagtgctgaggcgccccacgcgcgtcctcaggggaagccaggcactgagaacaaaggttgtgggaccgctctttgaggaactcaccagctccgcgagctcgcggccgccagcgcggtccacccattggcgggagaggactcacagaccgcagctcctcaccccgcctgctccgcagcgggaccgcgtagacctcagctccccgagcagcgcaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggaacaacctgccacactttcagctgcccatggcatttatgggcacaagtcatgttccagcacatccctggacccatgggcttctcagagtggttacctcgaaacagctaagtagcttcctttccagttttaaacccctagtgcatagcccaagagcaccccaaaaatgcaggttaatgatggagataactttatttgccaaattttgtaatttggagcttaagaaccactgtttttcctcttgagttctggcctgtaccaagtgcagaaatagcttcccaaaggaaaaaaatgggcaacagtaccaaatgctgctgagaggtcaagaaagaagaaggctgagaactgattactgaatttggccacctggaggtacttggggaccctgacaagaggcacagcctccgttgctgtggcagggatcttggctgctctgcgaatcaccaagaacaagctttccaatcacgtgtttgttttccaaggtgcaggcgaggcagctatgggcattgcccacctccttgtcatggccct

SEQ ID NO: 17034 - DNA, 298 bp, Homo sapiens
cctgctccgcagcgggaccgcgtagacctcagctccccgagcagcgcaggtgggccagggaaggagaggaccgaggcaagccaccacgcgggattaggggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggt

SEQ ID NO: 17035 - DNA, 487 bp, Homo sapiens
tttagtcttgccaagatggagagtctcaggcgggcattctgagctgcttcttgtcactggggaaaaccacgtgcacgcagtgctgaggcgccccacgcgcgtcctcaggggaagccaggcactgagaacaaaggttgtgggaccgctctttgaggaactcaccagctccgcgagctcgcggccgccagcgcggtccacccattggcgggagaggactcacagaccgcagctcctcaccccgcctgctccgcagcgggaccgcgtagacctcagctccccgagcagcgcaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaag

SEQ ID NO: 17036 - DNA, 814 bp, Homo sapiens
gtgcatttagtcttgccaagatggagagtctcaggcgggcattctgagctgcttcttgtcactggggaaaaccacgtgcacgcagtgctgaggcgccccacgcgcgtcctcaggggaagccaggcactgagaacaaaggttgtgggaccgctctttgaggaactcaccagctccgcgagctcgcggccgccagcgcggtccacccattggcgggagaggactcacagaccgcagctcctcaccccgcctgctccgcagcgggaccgcgtagacctcagctccccgagcagcgcaggtgggccagggaaggagaggaccgaggcaagccaccacgcgggattaggggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgacttt

SEQ ID NO: 17037 - DNA, 384 bp, Homo sapiens
cagcgcggtccacccattggcgggagaggactcacagaccgcagctcctcaccccgcctgctccgcagcgggaccgcgtagacctcagctccccgagcagcgcaggtgggccagggaaggagaggaccgaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggtaatgggccagagggcaggacggcccgcgttgcgatcccgtggctgccggaaaat

SEQ ID NO: 17038 - DNA, 2311 bp, Homo sapiens
aaacgcaaatccccctctgtgcatttagtcttgccaagatggagagtctcaggcgggcattctgagctgcttcttgtcactggggaaaaccacgtgcacgcagtgctgaggcgccccacgcgcgtcctcaggggaagccaggcactgagaacaaaggttgtgggaccgctctttgaggaactcaccagctccgcgagctcgcggccgccagcgcggtccacccattggcgggagaggactcacagaccgcagctcctcaccccgcctgctccgcagcgggaccgcgtagacctcagctccccgagcagcgcaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctgaggcagtctcagaggctagtatggggctagatgaagcccagagtaacacccacaatataaatgggttccaaaatggcccaagtgaatccttgtcgctgtgttttttcttttaaactttctggtgtgagaggagatgccaaggcatacagtgaataaaagccttgtctctg

SEQ ID NO: 17039 - DNA, 1629 bp, Homo sapiens
cccgcaccggatctgcttccagggcttggtttcgctttgcctggctcttggctaggcctggcgccccgcgcggagccgagcaggtggcagccgaggagtggcgggggctggaacatttaaccctttgggagcacctgccctctcccagagggcgcgtccccggatcaggcccggtgccccgcagcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaagctcccagcaccgcgcctgctacatgatagatgcctaataaatgtttaaagaatatatgaatgatgtctacacatacaaactgacatcctcataagcacacccacctgttcatgtgagtatgtctacactggacacctgcccctgcagcctctctgttatccaggtcatcattcatgtacagctgacccttgaacaaaggtggtggttacaggtgccaatgccccacacagtcaaaaatctgcataacttttgcctctccagaaacttagctactaatagcctactgttgaccagaagccttactaataacatcagtagtggattaacacataaatagactagtatctatccctattttatgtatgcatgacatacctaacttcttaatttttttgatatttctaggctacacagttcatctgtgagtgttcgcaaattgttacaaacctccaaaattttaaaaaatatatgtattgaaaaaatctgcatataagtggactcacacagctcaaccccatgttgttcaaggattgactgtgctcacatataaatgcacctctacatgtgctcatacatattcacatgtgtaccccacatgcagacacatggagctgtttgtttttaattaaatcaatccatttgtttac

SEQ ID NO: 17040 - DNA, 2193 bp, Homo sapiens
ggcagctgttgtggggcaccatgcgaggcttcgggccaggcttgacggccaggcgtctcctcccgctgcggttgcccccgcggccgcccgggccccggctggcgagcgggcaggcggccggcgccctggagcgggccatggacgagctgctgcgccgcgcggtgccgccgacgccggcctacgagctgcgcgagaagacaccggcgcccgccgagggtcagtgcgcggacttcgtgagcttctacggtgggctggccgagacggcccagcgggccgaactgctgggccgcctggcgcggggcttcggcgtggaccacggccaggtggcggagcagagcgccggcgtgctccatctgcgccagcagcagcgggaggcggcggtgctgctgcaggccgaggaccggctgcgctacgcgctggtgccgcgctatcgcggcctcttccaccacatcagcaagctggacggcggcgtgcgcttcctggtgcagctgcgggccgacctgctggaggcgcaggccctcaagctggtggaggggccggacgtccgggaaatgaatggggtgctgaaaggaatgctctcagaatggttttcctccgggttcctgaacctagaacgggttacctggcattcaccgtgtgaagtgcttcagaaaatcagtgaggctgaggctgtgcatcctgtaaaaaactggatggacatgaagcgccgcgttgggccctacagaaggtgttacttcttttctcactgttcgacccctggggagcccctggtcgttttgcacgtggcactgactggtgacatctccagcaacatccaggcaatcgtgaaggaacatcctccatcagaaacagaagagaagaacaaaatcactgctgcgatcttttattccatcagcttgacccagcagggactccaaggggtggagctgggaacattcctcataaagcgagtcgtcaaggagttgcagagagagtttcctcaccttggggtgttttcaagtctgtcacctatacctggtttcaccaaatggcttctggggcttctgaactcgcaaacgaaggagcatgggaggaatgaactctttacagattcggaatgtaaggaaatctcggagatcacaggtggccccattaacgagaccctcaagctcctcctcagcagcagcgagtgggtgcagtcggagaagctggtgcgggcgctgcagactccgctgatgaggctgtgcgcctggtacctgtatggagagaagcaccgcggctacgcgctgaaccccgtggccaacttccacctgcagaacggggcggtgctgtggcgcatcaactggatggcggatgtgagcctcagaggcatcaccggctcctgcggcctgatggccaactaccgctacttcctggaggagacgggccccaacagcacctcctacctcggctccaagatcatcaaagcctctgagcaggtcctcagcctagtggcccagtttcaaaagaacagcaagctctgacagtaaacctctcctaaagcacagggccccggctaagaaaacgatcattttcaggaggggccgggagttatgtatctgaagcagctttccaagcaaagccaaagttgactgtgttcttgtcccgcagccggtccacactgtgaggccaggcctcaacttccctcaccctgggcgtgacatgcacccagtgcaagacggttgtgggtgcgggtgcacacaaatgagtgggttgctgtgctgtctccggaagattctgtcgttgcccttggcctggctccctgcccggggctggtgctgtggtacctacatcttcaggaagctgtgcagcctctgccattgccatcccagggggatctggcatcctcctaaggaccggggcgcgtggcccagataagaataggtgttcctttgtgctcataaaacagaatgcggcgatggttgctttagccgtttctcaccatgcaatgcagagggacaaagggctgtgctacacttcccagttacattctgaagctcataaatgtatgagaaggtttgtgattttgcacaaggtgtgtgtagtaagttaaattgttgaacacaaaaatgttgctgcttgaggcataagttggataataggctttaaatgatcagggattcaggttcataatgaacttcacagtaaagaacacgtttgttctgtaaagcattg

SEQ ID NO: 17041 - DNA, 790 bp, Homo sapiens
gggttaacactgggaaataaaaacttcccacccacttcttgcaggaggctgtgtggttaaatcctgttacattatacttcagctcttaccatggccttgtcattgggttgaactggagctgtattttagattttgccaacaataacaagcgctgccaagtacttcagctgagatcacccaaataatactctactagcaaaagctttgcgtggcgttctaaccatcagaaactgagatggcaagaaagaagctgaaaaaatttactactttggagattgtgctcagtgttcttctgcttgtgttgtttatcatcagtattgttctaattgtgcttttagccaaagagtcactgaaatcaacagccccagatcctgggacaactggtaccccagatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggccacatgtgaccaacgtggctgttgctggaatccccagggagctgtaagtgttccctggtgctactattccaagaatcatagctaccatgtagagggcaaccttgtcaacacaaatgcaggattcacagcccggttgaaaaatctgccttcttcaccagtgtttggaagcaatgttgacaatgttcttctcacagcagaatatcagacatctaatcgtttccacttt

SEQ ID NO: 17042 - DNA, 4986 bp, Homo sapiens
gctgtaagtgttccctggtgctactattccaagaatcatagctaccatgtagagggcaaccttgtcaacacaaatgcaggattcacagcccggttgaaaaatctgccttcttcaccagtgtttggaagcaatgttgacaatgttcttctcacagcagaatatcagacatctaatcgtttccactttaagttgactgaccaaaccaataacaggtttgaagtgccccacgaacacgtgcagtccttcagtggaaatgctgctgcttctttgacctaccaagttgaaatctccagacagccatttagcatcaaagtgaccagaagaagcaacaatcgtgttttgtttgactcgagcattgggcccctactgtttgctgaccagttcttgcagctctccactcgactgcctagcactaacgtgtatggcctgggagagcatgtgcaccagcagtatcggcatgatatgaattggaagacctggcccatatttaacagagacacaactcccaatggaaacggaactaatttgtatggtgcgcagacattcttcttgtgccttgaagatgctagtggattgtcctttggggtgtttctgatgaacagcaatgccatggaggttgtccttcagcctgcgccagccatcacttaccgcaccattgggggcattctcgacttctatgtgttcttgggaaacactccagagcaagttgttcaagaatatctagagctcattgggcggccagcccttccctcctactgggcgcttggatttcacctcagtcgttacgaatatggaaccttagacaacatgagggaagtcgtggagagaaatcgcgcagcacagctcccttatgatgttcagcatgctgatattgattatatggatgagagaagggacttcacttatgattcagtggattttaaaggcttccctgaatttgtcaacgagttacacaataatggacagaagcttgtcatcattgtggatccagccatctccaacaactcttcctcaagtaaaccctatggcccatatgacaggggttcagatatgaagatatgggtgaatagttcagatggagtgactccactcattggggaggtctggcctggacaaactgtgtttcctgattataccaatcccaactgtgctgtttggtggacaaaggaatttgagctttttcacaatcaagtagagtttgatggaatctggattgatatgaatgaagtctccaactttgttgatggttcggtctcaggatgttccacaaacaacctaaataatcccccattcactcccagaatcctggatgggtacctgttctgcaagactctctgtatggatgcagtgcagcactggggcaagcagtatgacattcacaatctgtatggctactccatggcggtcgccacagcagaagctgccaagactgtgttccctaataagagaagcttcattctgacccgttctacctttgcgggctctggcaagtttgcagcacattggttaggagacaacactgccacctgggatgacctgagatggtccatccctggcgtgcttgagttcaacctttttggcatcccaatggtgggtcctgacatatgtggctttgctttggacacccctgaggagctctgtaggcggtggatgcagttgggtgcattttatccgttttctagaaatcacaatggccaaggctacaaggaccaggatcctgcctcctttggagctgactccctgctgttgaattcctccaggcactaccttaacatccgctatactctattgccctacctatacaccctcttcttccgtgctcacagccgaggggacacggtggccaggccccttttgcatgagttctacgaggacaacagcacttgggatgtgcaccaacagttcttatgggggcccggcctcctcatcactccagttctggatgaaggtgcagagaaagtgatggcatatgtgcctgatgctgtctggtatgactacgagactgggagccaagtgagatggaggaagcaaaaagtcgagatggaacttcctggagacaaaattggacttcaccttcgaggaggctacatcttccccacacagcagccaaatacaaccactctggccagtcgaaagaaccctcttggtcttatcattgccctagatgagaacaaagaagcaaaaggagaacttttctgggataatggggaaacgaaggatactgtggccaataaagtgtatcttttatgtgagttttctgtcactcaaaaccgcttggaggtgaatatttcacaatcaacctacaaggaccccaataatttagcatttaatgagattaaaattcttgggacggaggaacctagcaatgttacagtgaaacacaatggtgtcccaagtcagacttctcctacagtcacttatgattctaacctgaaggttgccattatcacagatattgatcttctcctgggagaagcatacacagtggaatggagcataaagataagggatgaagaaaaaatagactgttaccctgatgagaatggtgcttctgccgaaaactgcactgcccgtggctgtatctgggaggcatccaattcttctggagtccctttttgctattttgtcaacgacctatactctgtcagtgatgttcagtataattcccatggggccacagctgacatctccttaaagtcttccgtttatgccaatgccttcccctccacacccgtgaacccccttcgcctggatgtcacttaccataagaatgaaatgctgcagttcaagatttatgatcccaacaagaatcggtatgaagttccagtccctctgaacatacccagcatgccatccagcacccctgagggtcaactctatgatgtgctcattaagaagaatccatttgggattgaaattcgccggaagagtacaggcactataatttgggactctcagctccttggctttaccttcagtgacatgtttatccgcatctccacccgccttccctccaagtacctctatggctttggggaaactgagcacaggtcctataggagagacttggagtggcacacttgggggatgttctcccgagaccagcccccagggtacaagaagaattcctatggtgtccacccctactacatggggctggaggaggacggcagtgcccatggagtgctcctgctgaacagcaatgccatggatgtgacgttccagcccctgcctgccttgacataccgcaccacagggggagttctggacttttatgtgttcttggggccgactccagagcttgtcacccagcagtacactgagttgattggccggcctgtgatggtaccttactggtctttggggttccagctgtgtcgctatggctaccagaatgactctgagatcgccagcttgtatgatgagatggtggctgcccagatcccttatgatgtgcagtactcagacatcgactacatggagcggcagctggacttcaccctcagccccaagtttgctgggtttccagctctgatcaatcgcatgaaggctgatgggatgcgggtcatcctcattctggatccagccatttctggcaatgagacacagccttatcctgccttcactcggggcgtggaggatgacgtcttcatcaaatacccaaatgatggagacattgtctggggaaaggtctggcctgattttcctgatgttgttgtgaatgggtctctagactgggacagccaagtggagctatatcgagcttatgtggccttcccagactttttccgtaattcaactgccaagtggtggaagagggaaatagaagaactatacaacaatccacagaatccagagaggagcttgaagtttgatggcatgtggattgatatgaatgaaccatcaagcttcgtgaatggggcagtttctccaggctgcagggacgcctctctgaaccaccctccctacatgccacatttggagtccagggacaggggcctgagcagcaagaccctttgtatggagagtcagcagatcctcccagacggctccctggtgcagcactacaacgtgcacaacctgtatgggtggtcccagaccagacccacatacgaagccgtgcaggaggtgacgggacagcgaggggtcgtcatcacccgctccacatttccctcttctggccgctgggcaggacattggctgggagacaacacggccgcatgggatcagctgaagaagtctatcattggcatgatggagttcagcctctttggcatatcctatacgggagcagatatctgtgggttctttcaagacgctgagtacgagatgtgtgttcgctggatgcagctgggggccttttaccccttctcaagaaaccacaataccattgggaccaggagacaagaccctgtgtcctgggatgctgcttttgtgaatatttccagaaatgtcctgcagaccagatacaccctgttgccatatctgtataccttgatgcaaaaggcccacacggagggcgtcactgttgtgcggcctctgctccatgagtttgtgtcagaccaggtgacatgggacatagacagtcagttcctgctgggcccagccttcctggtcagccctgtcctggagcgcaatgccagaaatgtcactgcatatttccctagagcccgttggtacgattactacacgggtgtggatattaatgcaagaggagagtggaagaccttgccagcccctcttgaccacattaatcttcatgtccgtgggggctacatcctgccctggcaagagcctgcactgaacacccacttaagtcgaaagaaccctcttggtcttattattgccctagatgaaaacaaagaagcaaaaggagaacttttctgggatgatgggcaaacaaaggatactgtggccaagaaagtatatcttttatgtgagttttctgtcactcaacaagtagtgtttctaaatatagtttttaat

SEQ ID NO: 17043 - DNA, 6525 bp, Homo sapiens
agatctttggttgctttggtggactgtgctcctctgcttttattgctaagccatccttcagacagagagggagcggctgcaagaggtaatgagagatggcaagaaagaagctgaaaaaatttactactttggagattgtgctcagtgttcttctgcttgtgttgtttatcatcagtattgttctaattgtgcttttagccaaagagtcactgaaatcaacagccccagatcctgggacaactggtaccccagatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggccacatgtgaccaacgtggctgttgctggaatccccagggagctgtaagtgttccctggtgctactattccaagaatcatagctaccatgtagagggcaaccttgtcaacacaaatgcaggattcacagcccggttgaaaaatctgccttcttcaccagtgtttggaagcaatgttgacaatgttcttctcacagcagaatatcagacatctaatcgtttccactttaagttgactgaccaaaccaataacaggtttgaagtgccccacgaacacgtgcagtccttcagtggaaatgctgctgcttctttgacctaccaagttgaaatctccagacagccatttagcatcaaagtgaccagaagaagcaacaatcgtgttttgtttgactcgagcattgggcccctactgtttgctgaccagttcttgcagctctccactcgactgcctagcactaacgtgtatggcctgggagagcatgtgcaccagcagtatcggcatgatatgaattggaagacctggcccatatttaacagagacacaactcccaatggaaacggaactaatttgtatggtgcgcagacattcttcttgtgccttgaagatgctagtggattgtcctttggggtgtttctgatgaacagcaatgccatggaggttgtccttcagcctgcgccagccatcacttaccgcaccattgggggcattctcgacttctatgtgttcttgggaaacactccagagcaagttgttcaagaatatctagagctcattgggcggccagcccttccctcctactgggcgcttggatttcacctcagtcgttacgaatatggaaccttagacaacatgagggaagtcgtggagagaaatcgcgcagcacagctcccttatgatgttcagcatgctgatattgattatatggatgagagaagggacttcacttatgattcagtggattttaaaggcttccctgaatttgtcaacgagttacacaataatggacagaagcttgtcatcattgtggatccagccatctccaacaactcttcctcaagtaaaccctatggcccatatgacaggggttcagatatgaagatatgggtgaatagttcagatggagtgactccactcattggggaggtctggcctggacaaactgtgtttcctgattataccaatcccaactgtgctgtttggtggacaaaggaatttgagctttttcacaatcaagtagagtttgatggaatctggattgatatgaatgaagtctccaactttgttgatggttcggtctcaggatgttccacaaacaacctaaataatcccccattcactcccagaatcctggatgggtacctgttctgcaagactctctgtatggatgcagtgcagcactggggcaagcagtatgacattcacaatctgtatggctactccatggcggtcgccacagcagaagctgccaagactgtgttccctaataagagaagcttcattctgacccgttctacctttgcgggctctggcaagtttgcagcacattggttaggagacaacactgccacctgggatgacctgagatggtccatccctggcgtgcttgagttcaacctttttggcatcccaatggtgggtcctgacatatgtggctttgctttggacacccctgaggagctctgtaggcggtggatgcagttgggtgcattttatccgttttctagaaatcacaatggccaaggctacaaggaccaggatcctgcctcctttggagctgactccctgctgttgaattcctccaggcactaccttaacatccgctatactctattgccctacctatacaccctcttcttccgtgctcacagccgaggggacacggtggccaggccccttttgcatgagttctacgaggacaacagcacttgggatgtgcaccaacagttcttatgggggcccggcctcctcatcactccagttctggatgaaggtgcagagaaagtgatggcatatgtgcctgatgctgtctggtatgactacgagactgggagccaagtgagatggaggaagcaaaaagtcgagatggaacttcctggagacaaaattggacttcaccttcgaggaggctacatcttccccacacagcagccaaatacaaccactctggccagtcgaaagaaccctcttggtcttatcattgccctagatgagaacaaagaagcaaaaggagaacttttctgggataatggggaaacgaaggatactgtggccaataaagtgtatcttttatgtgagttttctgtcactcaaaaccgcttggaggtgaatatttcacaatcaacctacaaggaccccaataatttagcatttaatgagattaaaattcttgggacggaggaacctagcaatgttacagtgaaacacaatggtgtcccaagtcagacttctcctacagtcacttatgattctaacctgaaggttgccattatcacagatattgatcttctcctgggagaagcatacacagtggaatggagcataaagataagggatgaagaaaaaatagactgttaccctgatgagaatggtgcttctgccgaaaactgcactgcccgtggctgtatctgggaggcatccaattcttctggagtccctttttgctattttgtcaacgacctatactctgtcagtgatgttcagtataattcccatggggccacagctgacatctccttaaagtcttccgtttatgccaatgccttcccctccacacccgtgaacccccttcgcctggatgtcacttaccataagaatgaaatgctgcagttcaagatttatgatcccaacaagaatcggtatgaagttccagtccctctgaacatacccagcatgccatccagcacccctgagggtcaactctatgatgtgctcattaagaagaatccatttgggattgaaattcgccggaagagtacaggcactataatttgggactctcagctccttggctttaccttcagtgacatgtttatccgcatctccacccgccttccctccaagtacctctatggctttggggaaactgagcacaggtcctataggagagacttggagtggcacacttgggggatgttctcccgagaccagcccccagggtacaagaagaattcctatggtgtccacccctactacatggggctggaggaggacggcagtgcccatggagtgctcctgctgaacagcaatgccatggatgtgacgttccagcccctgcctgccttgacataccgcaccacagggggagttctggacttttatgtgttcttggggccgactccagagcttgtcacccagcagtacactgagttgattggccggcctgtgatggtaccttactggtctttggggttccagctgtgtcgctatggctaccagaatgactctgagatcgccagcttgtatgatgagatggtggctgcccagatcccttatgatgtgcagtactcagacatcgactacatggagcggcagctggacttcaccctcagccccaagtttgctgggtttccagctctgatcaatcgcatgaaggctgatgggatgcgggtcatcctcattctggatccagccatttctggcaatgagacacagccttatcctgccttcactcggggcgtggaggatgacgtcttcatcaaatacccaaatgatggagacattgtctggggaaaggtctggcctgattttcctgatgttgttgtgaatgggtctctagactgggacagccaagtggagctatatcgagcttatgtggccttcccagactttttccgtaattcaactgccaagtggtggaagagggaaatagaagaactatacaacaatccacagaatccagagaggagcttgaagtttgatggcatgtggattgatatgaatgaaccatcaagcttcgtgaatggggcagtttctccaggctgcagggacgcctctctgaaccaccctccctacatgccacatttggagtccagggacaggggcctgagcagcaagaccctttgtatggagagtcagcagatcctcccagacggctccctggtgcagcactacaacgtgcacaacctgtatgggtggtcccagaccagacccacatacgaagccgtgcaggaggtgacgggacagcgaggggtcgtcatcacccgctccacatttccctcttctggccgctgggcaggacattggctgggagacaacacggccgcatgggatcagctgaagaagtctatcattggcatgatggagttcagcctcttcggcatatcctatacgggagcagatatctgtgggttctttcaagatgctgaatatgagatgtgtgttcgctggatgcagctgggggccttttaccccttctcaagaaaccacaacaccattgggaccaggagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtttgtgtcagaccaggtgacatgggacatagacagtcagttcctgctgggcccagccttcctggtcagccctgtcctggagcgtaatgccagaaatgtcactgcatatttccctagagcccgctggtatgattactacacgggtgtggatattaatgcaagaggagagtggaagaccttgccagcccctcttgaccacattaatcttcatgtccgtgggggctacatcctgccctggcaagagcctgcactgaacacccacttaagccgccagaaattcatgggcttcaaaattgccttggatgatgaaggaactgctgggggctggctcttctgggatgatgggcaaagcattgatacctatgggaaaggactctattacttggccagcttttctgccagccagaatacgatgcaaagccatataattttcaacaattacatcactggtacaaatcctttgaaactgggctacattgaaatctggggagtgggcagtgtccccgttaccagtgtcagcatctctgtgagtggcatggtcataacaccctccttcaacaatgaccccacgacacaggtattaagcatcgatgtgactgacagaaacatcagcctacataattttacttcattgacgtggataagcactctgtgaatttttacagcaagattctaactaactatgaatgactttgaaactacttatacttcatactcataaaaattattgtgtgttgctaatttgttcatacccactattggtgaaatatttctgttaattttgttatatgttttttgtgtgaaccctaaaggttaaaccttagccctgtgggataggcagttagggaggtgtggaaaatctatgcattaccttaatgtctctgtgtggttagtatggtagtgactgttcatcatatgacatttactgaagatgaactgggtccatgatgaagtgtgtgtatgtccacgtttgtaatcatagaatggaccccattcttttgttaaatacacaagagaaagctttctgtgacagttccaggtcttgaagctaatcagcatctcaagaaagtatccagaaagaacatctgctagttggttataggcggtgggaggaataatatacctaattggttataggtggggggagcatgataagcaaagaaaaggcaaacacaaggaaagatcagatgaaacagaagatgatagtaaaagtgatcctaagtaagaacataatgtaaaattgtcagcagcctcatggggaggaaaaaggaagagtcaactcacttgaagaagagggtcttgagaaatccttagcataaagggctactggtgagattgagatctgagcaggcaaagctcaaaagagagtttggaggttaaaaataatttatttttgcagtagtgtgctttgaaatgtgtaaatcttatttctaatgtatacaaccacatttcacataaaaatatgcaatttatatgccagataaaaataaaacaagtgaatttgcaagtga

SEQ ID NO: 17044 - DNA, 3616 bp, Homo sapiens
aaattttcctccaggctgtccttggagaattccaccctctttcattctggggagaagaagttaaaattagggccagccctgcgggactgacatgccagatgcagggaagctgtccccagaaataagcgagttcccaccgcggctgggcggggcgggagcctcgggtcccaacccagcggagggactcctggaaggcctgccccttccaagtgtctgcaagggctctggtcccaagctttaaaatcctgagcgaaggcactgcgggccgacctctcctctcccagccagtcgtggctggcctttcaaagtgtgcagttgtctcctccctgtccagccccatcgtcgcccaggaccagctgggccgcggtctgacctgaggctgctgctcagcgccggggcgctggcgctctccattcgagcaccttccagcataccgctcggctccgggagccgctctgcaaagttgggcagctcagagcgcaagctttgcctctcgacttctccctccttgggtccccggcgcccccgcctcccacgatccctttcactaggagcagccagtcccagcgggctggcaacttgcaccccttcctagtcatcctccctgaaacgcgaccatgctgttaaggggcgtcctcctggcgttgcaagccctgcagctcgccggtgccctcgacctgcccgctgggtcctgtgcctttgaagagagcacttgcggctttgactccgtgttggcctctctgccgtggattttaaatgaggaaggccattacatttatgtggatacctcctttggcaagcagggggagaaagctgtgctgctaagtcctgacttacaggctgaggaatggagctgcctccgtttggtctaccagataaccacatcttcggagtctctgtcagatcccagccagctgaacctctacatgagatttgaagatgaaagctttgatcgcttgctttggtcagctaaggaaccttcagacagctggctcatagccagcttggatttgcaaaacagttccaagaaattcaagattttaatagaaggtgtactaggacagggaaacacagccagcatcgcactatttgaaatcaagatgacaaccggctactgtattgaatgtgactttgaagaaaatcatctctgtggctttgtgaaccgctggaatcccaatgtgaactggtttgttggaggaggaagtattcggaatgtccactccattctcccacaggatcacaccttcaagagtgaactgggccactacatgtacgtggactcagtttatgtgaagcacttccaggaggtggcacagctcatctccccgttgaccacggcccccatggctggctgcctgtcattttattaccagatccagcaggggaatgacaatgtcttttccctttacactcgggatgtggctggcctttacgaggaaatctggaaagcagacaggccagggaatgctgcctggaaccttgcggaggtcgagttcagtgctccttaccccatggaggttatttttgaagttgctttcaatggtcccaagggaggttatgttgccctggatgatatttcattctctcctgttcactgccagaatcagacagaacttctgttcagtgccgtggaagccagctgcaattttgagcaagatctctgcaacttttaccaagataaagaaggtccaggttggacccgagtgaaagtaaaaccaaacatgtatcgggctggagaccacactacaggcttagggtattacctgctagccaacacaaagttcacatctcagcctggctacattggaaggctctatgggccctccctaccaggaaacttgcagtattgtctgcgttttcattatgccatctatggatttttaaaaatgagtgacaccctagcagtttacatctttgaagagaaccatgtggttcaagagaagatctggtctgtgttggagtccccaaggggtgtttggatgcaagctgaaatcacctttaagaagcccatgcctaccaaggtggttttcatgagcctatgcaaaagtttctgggactgtgggcttgtagccctggatgacattacaatacaattgggaagctgctcatcttcagagaaacttccacctccacctggagagtgtactttcgagcaagatgaatgtacatttactcaggagaaaagaaaccggagcagctggcacaggaggaggggagaaactcccacttcctacacaggaccaaagggagatcacactactggggtaggctactacatgtacattgaggcctcccatatggtgtatggacaaaaagcacgcctcttgtccaggcctctgcgaggagtctctggaaaacactgcttgacctttttctaccacatgtatggagggggcactggcctgctgagtgtttatctgaaaaaggaagaagacagtgaagagtccctcttatggaggagaagaggtgaacagagcatttcctggctacgagcactgattgaatacagctgtgagaggcaacaccagataatttttgaagccattcgaggagtatcaataagaagtgatattgccattgatgatgttaaatttcaggcaggaccctgtggagaaatggaagatacaactcaacaatcatcaggatattctgaggacttaaatgaaattgagtattaagaaatgatctgcattggatttactagacgaaaaccatacctctcttcaatcaaaatgaaaacaaagcaaatgaatactggacagtcttaacaattttataagttataaaatgactttagagcaccctccttcattacttttgcaaaaacatactgactcagggctctttttttctttttgcatatgacaactgttactagaaatacaggctactggttttgcatagatcattcatcttaattttggtaccagttaaaaatacaaatgtactatattgtagtcattttaaagtacacaaagggcacaatcaaaatgagatgcactcatttaaatctgcattcagtgaatgtattgggagaaaaataggtcttgcaggtttccttttgaattttaagtatcataaatatttttaaagtaaataatacggggtgtcagtaatatctgcagaatgaatgcagtctttcatgctaatgagttagtctggaaaaataaagtcttattttctatgttttattcatagaaatggagtattaatttttaatattttcaccatatgtgataacaaaggatctttcatgaatgtccaagggtaagtcagtattaattaatgctgtattacaaggcaatgctaccttctttattccccctttgaactacctttgaagtcactatgagcacatggatagaaatttaacttttttttgtaaagcaagcttaaaatgtttatgtatacatacccagcaacttttataaatgtgttaaacaattttactgatttttataataaatattttggtaagattttgaataatatgaattcaggcagatatactaaactgcttttatttacttgtttagaaaattgtatatatatgtttgtgtatcctaacagctgctatgaaattataaaattacctaataaaaataatttgaaaatc

SEQ ID NO: 17045 - DNA, 8919 bp, Homo sapiens
ggagagcgagagaccgaacgaggagacgcgaggaggagggaggaggaagagagggagggaggcgggaggagcgcggaatgaaaagctcggaggggcgaaaaagcagcacagcaaagcccaagttgctgagcgagcggagcgctcccgcggcccggagccgagcggccgccgcgccccggagcccggcccggccccgcccgctctgggcccccgcaggccaaggccgccgggcgggggcggggacgaccaacttggggcgcggcgtagccccgctctcccgagagctcggagcccgggagggctacggccgcggccagacggcgggagaggagcgcggcgagcggaggcggcgagcggcgcccgcgccgcagccccggcctgggcgagagcgcgaatatttttcaaaagactcaaactttcctcctttccccgttttctggggcccttcttgcctggaattgctctccagattcccgcggggcgccgggctgctattcttcccccgggtttatcggcggctcggctaacttcacggacccggggacccgcggcgctcgtccctcggccgaacccagcccgcgctgctccccggatcaggagggccgggcccggggctgcttcgccgccgcgagtgctttcagcccggccccctggagtcgggccgctgagcccacggcagcggccgcaggactggaaacagcagattgattaactcgagcggagccccggcctccccgactccgctccgctgaggggcggccccagtgcggggaaacgacaagtttgtcagtcgtccgtggcctgttggatcgaagcgccgcctccgccgccgagaggtccccggcgcctagcatcccgcgcggacggccctgggtacccggggcggctcggcggccgggctcctcgggtcggggcgctggctgctgtgccgggcgcgccgaggcacccggggctgggccagcgccccctgcgtccccacgcgggcagcggccccgccggaggagaaacacgggtcgccgccacctccgcctcttcagtctcctggtcttcgtcgccgctctctctctcacctctcagggaaagggggggacataggggcgtcgcggggccccggcgaatgcgccccccgccgcctctcgggctgcgccgcctcgcggggatgaagcaccggccgtgaagatggaggtgacctgccttctacttctggcgctgatccccttccactgccggggacaaggagtctacgctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatgctgacggtgcaccagacggtgagcgatgtgcgaggcaacttctaccaggagaagacggtgttcctgcgctgtactgtcaactccaacccgcctgcccgcttcatctggaagcggggttccgataccctatcccacagccaggacaatggggttgacatctatgagcccctctacactcagggggagaccaaggtcctgaagctgaagaacctgcggccccaggactatgccagctacacctgccaggtgtctgtgcgtaacgtgtgcggcatcccagacaaggccatcaccttccggctcaccaacaccacggcaccaccagccctgaagctgtctgtgaacgaaactctggtggtgaaccctggggagaatgtgacggtgcagtgtctgctgacaggcggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagtccccatgcttcccgccggaggtggagcccagttcccaggacgtgcgccaggcgctgggccggcccgtgctcctgcgctgctcgctgctgcgaggcagcccccagcgcatcgcctcggctgtgtggcgtttcaaagggcagctgctgccgccgccgcctgttgttcccgccgccgccgaggcgccggatcacgcggagctgcgcctcgacgccgtaactcgcgacagcagcggcagctacgagtgcagcgtctccaacgatgtgggctcggctgcctgcctcttccaggtctccgccaaagcctacagcccggagttttacttcgacacccccaaccccacccgcagccacaagctgtccaagaactactcctacgtgctgcagtggactcagagggagcccgacgctgtcgaccctgtgctcaactacagactcagcatccgccagttgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagctcctggctctgaggaccctgtcctctgacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggctccctcaacctcctggtgcggtcccggaacaaaggggctctggacacgcacgcctggtctctcagtggcaataagggcaatgtgtggcagcaggcccatgtgcccatcagccccagtgggcccttccagattatttttgagggggttcgaggcccgggctacctgggggatattgccatagatgacgtcacactgaagaagggggagtgtccccggaagcagacggatcccaataaagtggtggtgatgccgggcagtggagccccctgccagtccagcccacagctgtgggggcccatggccatcttcctcttggcgttgcagagatgatgagagctgtgtggccacccccccaaccttgcccccggcacaccaaagtgtccacattgtaccaaagactgacccccgccagctggggtgcccaggggcagggccggcccgccagggagggggcctgcattggctgcaaggatgagcagagaacaaggacagaggccaggcactgaggccctggagacagctgttccacttgcacacacgcacacactcatgctcacacacacagagatatattaaagcacaagtttctatctgacctgccagcaccttctttactgcaaagacaggggacttgcctgaatggcatccgccaacccagggacctcggcgcaacataggccttgtccttgctgcactcgtggtgtgcttctgactttaccctgtcccctaagtcaaggccgaactccagcctggtggctttgccagaagggagccagaagtggggcagacatggagcccctcccttggtcagactctgggactcctgagatgggagaggcagggatcagaggacgaacaggtgggactttgcgagctctgtgactgtcccacgtccaggagacaaggaaggtagggcacctgctgcacacgattctgtccagagtgagcactggatggtggagaccataggtcaccccagattccttgacctatttctgggacaccatatttccctcctcagtgtgcaccctttgaagggacccagcacagggtcttgggcctgggcagtctgaagactgataacttccccactccaccctacaagcagtgggactcctgagaacacggttctctcctagcctcagcccccagctgggtctcagaggagctgggggagcggtggccagcccattttctggggtgaggcttgacttggagaaaggcagaagagacgtcccgcttctgtgatttggtgcccccatatcagacaatgaatttggaagtggagaggggccttcatttcttatctacttggcatgaaagggtgccctggataggagggtgtgtacagggcaaaatgccaaaaagcactgtctagttgaaagttcccttctccacccaggggcagtgaaggaggaggggcttatagagctgggattggtggagggagcaggtgccagtcccctcactctctgggagctgtgaaagggatccctgtccttgggtcctgggttaggcacctgagattgacatgatgggatctagatctttcctccttgacatcacctgagcccccacctagccatccatgggagagagaaggcccagccccttctagaatgactctttaggcatgcgtgcatatgtgtgtatgtgtttgtgcccgtctgtgtctaggtaccaccgtgggtacattgttgggcaggagtgtgtgcaaacacaggtctgtgtgtgcaatctcacatatctgcctgtgagactggattgagacccattcgtttctatgaatgtccgtgtacgtcagcgtgtgtgtccaccttcctgagtgatgtgttcgcttgtagggtgctggctgaatagactctgtccagccctgttctgtagtctcaagctgcctgcgatggcctgaaattccacctttcatcccctatggatgacggagagcttacagatgaccctattgaatgcaagcacctttggtgaggagcatcacagggctccttctggagcatttggtggggacagctgcagagaagaggcctggaactcgggcagcactgcagtgccaggaggcaggcggggaaccgaggcaaaggctgcccatctccccctgccaggcctgtgtgatcattatcaccaacagctggtgggtggccgggccaggatgcagcggggccttctgatgcccaatcagcacggctgccttcctgacccagtcaaggcctctgtctgaaatgagtcgctccaggttctcagcatacacttccatcgcgtctgtcgggtattgttccttaactgtcccatctgtgcagagtccattgccccaactagactgtgagctcctcctctgagccttccaagtcccccctccaccttcgccacctcccgctcgtgcccagcacaagtgagcctggtgtggaaaccactccattgcccggtggaatggattctgtaatcagtggttcctggccttgcctgcagaatagaaccaccagagtcctttaaaaagtattgctgcttggttcccacctcagaggttctgagttaattggactggagcgcagtcggacatcaagaaatgttgaaaagctccttgggttctcctgacagcaggaaccactggcctggcaccacctgggtgcttcctctgtgccctcgctggggtaggcattggagcaccagagatgaatagccccaagtgctccctctttggggttcccaaggcaccctgtgcctgcttccctcagaggaccttccaatccatttgccccgcaaccctggctgctccgacaggggagacttgtctcccttgttcccctcaggatccatagagtggacagtaaaggtgctcagtacatgttggctgagctgaactgcatacatgtggcccccaggttcctggtctttatggacgaagggcacaaggtggaggggggatggggggatgctgctggaggtctcagtgggtgcagacagccctgccttgaggatggcttgacctgggattgacaaaatgtgtctgctgaaatgctgaggtccccacgtgtgaatgggtgaggctgatgtggatgtctgtgtgtgccagcaggtgggtgggggatgtgggtgtcagtgtatgccagtgggcactgtaaatgtctaggcatgtgctggtctctgtgtgtttgtgtgttcctcagcaggaatgagtgtctttgtgtatcacctggtgacttgtcagtgtctgtgtctgtgtgtgcctgtgagccagcatctctgtatcagtgttgctcatgctgtgtctttgtgcgccatggtgtgtcagtgtctgtgtgttgatgggtggcccatgagtgacccccgccaggggagaccaggctggctggatccagcacatctccccagtggcagcctcgccctctgggtcagggtgactgaggcattttgtggccttaaaacggggtgttcagggtcagccctcagggtgctggggcccttccatcccttgtccccttcaggttggtgaaaaggactccgggggccaggtgctgtatagcagcttatggaagtctcagctgggctatcctgcccttgggagcacagacaggctcctagggtgctgagtgaagcctgaagaccaagccccctcctcctggaatgctccttccacccctacctctcagagatgggcctgacacctctttctcattcattctccttttccctgtgctctgggaaagcccctggctcaggctgtcagagtgaggatggacctcaaaagtttgatcccctcgtgcagatgaagaagctgaagcccagagtggggaaggggagtggcccaaggtcacacagctagtttgagtagagccagtcttgggagagccaagtactacagccctgggggtgtcacaccgcttgtcactgcccctgaggtctcctgccaaacaactgcagggagtttggctaacagtcctgtgtccagggtgccggtggggatgttatagatgttgctgggatcctgccctcggctccaaattctggcctctcatcccaggctgcagacccttctgccccatgacaggcctgggtgccacacagaggtggccaccctcccaccacagtgtctgcagctgctgcccttctcccaggcccccagacagaagagaccctgtttcccctcctctcccctgtgacttcacaagagcttgggctaggagtgaaggtcagcatgttctcatgtgctcatcctcttggtttccccaaagaccgggagggtcacggatggggcgtgcagaatccttgtgttttttctcgctgggcagcttgaggggctggggagtattcccagggtctttgctctggagagtccctgcagagccactggctgaggttgggttcagggttcagcggagtcctccatgcttccaaaggccgggaagcacccgcctctctatcgagtcagtgctgtgcgtgtgtgtctgagaatgtgtgtgatgtgtggagtgtgcgtgtgtttgtgtgtgtgtgtgtgtgtgttggggcagaaggaccactctttcctggggatcccttgacccttataactagaagggaccttagggagcatctaagctggtgcccccattgtacaggcgaggtccagagggatggcatctgcccaccccaccccttgccctcttgttgcctgcactcatttcccagggaccctcctaggataggactgccctccttcctggccccctcccgccatcctcccagccacccacataatcaccatctcagcccaactctggtggccctctaggtctccatgcattcttcctgccctagagtagccagctcaccaaggcctttatccccagcccaggagaagggtcagggagggaaggggctgcaccagccctgagacctcaaagacttgggagaaaagccaaaactcctcatgcccaggcccacatgtctgaccaccccagcccaccccgccaccaaggtaaaagcacaacaggagacccccttattaatgggtgaaatgattggggttgtttttttagtcacacagccccatcctcacccctttgccttgctgtctgtctccaccccagcctctgttccccatttgcctctctttcacctccaagcccccaaatgtaacctctagttgcggacgcggttgttctatcaataaagctgcagtgttctagcgctcagcgt

SEQ ID NO: 17046 - DNA, 10736 bp, Homo sapiens
ggagagcgagagaccgaacgaggagacgcgaggaggagggaggaggaagagagggagggaggcgggaggagcgcggaatgaaaagctcggaggggcgaaaaagcagcacagcaaagcccaagttgctgagcgagcggagcgctcccgcggcccggagccgagcggccgccgcgccccggagcccggcccggccccgcccgctctgggcccccgcaggccaaggccgccgggcgggggcggggacgaccaacttggggcgcggcgtagccccgctctcccgagagctcggagcccgggagggctacggccgcggccagacggcgggagaggagcgcggcgagcggaggcggcgagcggcgcccgcgccgcagccccggcctgggcgagagcgcgaatatttttcaaaagactcaaactttcctcctttccccgttttctggggcccttcttgcctggaattgctctccagattcccgcggggcgccgggctgctattcttcccccgggtttatcggcggctcggctaacttcacggacccggggacccgcggcgctcgtccctcggccgaacccagcccgcgctgctccccggatcaggagggccgggcccggggctgcttcgccgccgcgagtgctttcagcccggccccctggagtcgggccgctgagcccacggcagcggccgcaggactggaaacagcagattgattaactcgagcggagccccggcctccccgactccgctccgctgaggggcggccccagtgcggggaaacgacaagtttgtcagtcgtccgtggcctgttggatcgaagcgccgcctccgccgccgagaggtccccggcgcctagcatcccgcgcggacggccctgggtacccggggcggctcggcggccgggctcctcgggtcggggcgctggctgctgtgccgggcgcgccgaggcacccggggctgggccagcgccccctgcgtccccacgcgggcagcggccccgccggaggagaaacacgggtcgccgccacctccgcctcttcagtctcctggtcttcgtcgccgctctctctctcacctctcagggaaagggggggacataggggcgtcgcggggccccggcgaatgcgccccccgccgcctctcgggctgcgccgcctcgcggggatgaagcaccggccgtgaagatggaggtgacctgccttctacttctggcgctgatccccttccactgccggggacaaggagtctacgctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatgctgacggtgcaccagacggtgagcgatgtgcgaggcaacttctaccaggagaagacggtgttcctgcgctgtactgtcaactccaacccgcctgcccgcttcatctggaagcggggttccgataccctatcccacagccaggacaatggggttgacatctatgagcccctctacactcagggggagaccaaggtcctgaagctgaagaacctgcggccccaggactatgccagctacacctgccaggtgtctgtgcgtaacgtgtgcggcatcccagacaaggccatcaccttccggctcaccaacaccacggcaccaccagccctgaagctgtctgtgaacgaaactctggtggtgaaccctggggagaatgtgacggtgcagtgtctgctgacaggcggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagttcccgccggaggtggagcccagttcccaggacgtgcgccaggcgctgggccggcccgtgctcctgcgctgctcgctgctgcgaggcagcccccagcgcatcgcctcggctgtgtggcgtttcaaagggcagctgctgccgccgccgcctgttgttcccgccgccgccgaggcgccggatcacgcggagctgcgcctcgacgccgtaactcgcgacagcagcggcagctacgagtgcagcgtctccaacgatgtgggctcggctgcctgcctcttccaggtctccgccaaagcctacagcccggagttttacttcgacacccccaaccccacccgcagccacaagctgtccaagaactactcctacgtgctgcagtggactcagagggagcccgacgctgtcgaccctgtgctcaactacagactcagcatccgccagttgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagcccatcaactctccgaacctttcagacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggctccctcaacctcctggtgcggtcccggaacaaaggggctctggacacgcacgcctggtctctcagtggcaataagggcaatgtgtggcagcaggcccatgtgcccatcagccccagtgggcccttccagattatttttgagggggttcgaggcccgggctacctgggggatattgccatagatgacgtcacactgaagaagggggagtgtccccggaagcagacggatcccaataaagtggtggtgatgccgggcagtggagccccctgccagtccagcccacagctgtgggggcccatggccatcttcctcttggcgttgcagagatgatgagagctgtgtggccacccccccaaccttgcccccggcacaccaaagtgtccacattgtaccaaagactgacccccgccagctggggtgcccaggggcagggccggcccgccagggagggggcctgcattggctgcaaggatgagcagagaacaaggacagaggccaggcactgaggccctggagacagctgttccacttgcacacacgcacacactcatgctcacacacacagagatatattaaagcacaagtttctatctgacctgccagcaccttctttactgcaaagacaggggacttgcctgaatggcatccgccaacccagggacctcggcgcaacataggccttgtccttgctgcactcgtggtgtgcttctgactttaccctgtcccctaagtcaaggccgaactccagcctggtggctttgccagaagggagccagaagtggggcagacatggagcccctcccttggtcagactctgggactcctgagatgggagaggcagggatcagaggacgaacaggtgggactttgcgagctctgtgactgtcccacgtccaggagacaaggaaggtagggcacctgctgcacacgattctgtccagagtgagcactggatggtggagaccataggtcaccccagattccttgacctatttctgggacaccatatttccctcctcagtgtgcaccctttgaagggacccagcacagggtcttgggcctgggcagtctgaagactgataacttccccactccaccctacaagcagtgggactcctgagaacacggttctctcctagcctcagcccccagctgggtctcagaggagctgggggagcggtggccagcccattttctggggtgaggcttgacttggagaaaggcagaagagacgtcccgcttctgtgatttggtgcccccatatcagacaatgaatttggaagtggagaggggccttcatttcttatctacttggcatgaaagggtgccctggataggagggtgtgtacagggcaaaatgccaaaaagcactgtctagttgaaagttcccttctccacccaggggcagtgaaggaggaggggcttatagagctgggattggtggagggagcaggtgccagtcccctcactctctgggagctgtgaaagggatccctgtccttgggtcctgggttaggcacctgagattgacatgatgggatctagatctttcctccttgacatcacctgagcccccacctagccatccatgggagagagaaggcccagccccttctagaatgactctttaggcatgcgtgcatatgtgtgtatgtgtttgtgcccgtctgtgtctaggtaccaccgtgggtacattgttgggcaggagtgtgtgcaaacacaggtctgtgtgtgcaatctcacatatctgcctgtgagactggattgagacccattcgtttctatgaatgtccgtgtacgtcagcgtgtgtgtccaccttcctgagtgatgtgttcgcttgtagggtgctggctgaatagactctgtccagccctgttctgtagtctcaagctgcctgcgatggcctgaaattccacctttcatcccctatggatgacggagagcttacagatgaccctattgaatgcaagcacctttggtgaggagcatcacagggctccttctggagcatttggtggggacagctgcagagaagaggcctggaactcgggcagcactgcagtgccaggaggcaggcggggaaccgaggcaaaggctgcccatctccccctgccaggcctgtgtgatcattatcaccaacagctggtgggtggccgggccaggatgcagcggggccttctgatgcccaatcagcacggctgccttcctgacccagtcaaggcctctgtctgaaatgagtcgctccaggttctcagcatacacttccatcgcgtctgtcgggtattgttccttaactgtcccatctgtgcagagtccattgccccaactagactgtgagctcctcctctgagccttccaagtcccccctccaccttcgccacctcccgctcgtgcccagcacaagtgagcctggtgtggaaaccactccattgcccggtggaatggattctgtaatcagtggttcctggccttgcctgcagaatagaaccaccagagtcctttaaaaagtattgctgcttggttcccacctcagaggttctgagttaattggactggagcgcagtcggacatcaagaaatgttgaaaagctccttgggttctcctgacagcaggaaccactggcctggcaccacctgggtgcttcctctgtgccctcgctggggtaggcattggagcaccagagatgaatagccccaagtgctccctctttggggttcccaaggcaccctgtgcctgcttccctcagaggaccttccaatccatttgccccgcaaccctggctgctccgacaggggagacttgtctcccttgttcccctcaggatccatagagtggacagtaaaggtgctcagtacatgttggctgagctgaactgcatacatgtggcccccaggttcctggtctttatggacgaagggcacaaggtggaggggggatggggggatgctgctggaggtctcagtgggtgcagacagccctgccttgaggatggcttgacctgggattgacaaaatgtgtctgctgaaatgctgaggtccccacgtgtgaatgggtgaggctgatgtggatgtctgtgtgtgccagcaggtgggtgggggatgtgggtgtcagtgtatgccagtgggcactgtaaatgtctaggcatgtgctggtctctgtgtgtttgtgtgttcctcagcaggaatgagtgtctttgtgtatcacctggtgacttgtcagtgtctgtgtctgtgtgtgcctgtgagccagcatctctgtatcagtgttgctcatgctgtgtctttgtgcgccatggtgtgtcagtgtctgtgtgttgatgggtggcccatgagtgacccccgccaggggagaccaggctggctggatccagcacatctccccagtggcagcctcgccctctgggtcagggtgactgaggcattttgtggccttaaaacggggtgttcagggtcagccctcagggtgctggggcccttccatcccttgtccccttcaggttggtgaaaaggactccgggggccaggtgctgtatagcagcttatggaagtctcagctgggctatcctgcccttgggagcacagacaggctcctagggtgctgagtgaagcctgaagaccaagccccctcctcctggaatgctccttccacccctacctctcagagatgggcctgacacctctttctcattcattctccttttccctgtgctctgggaaagcccctggctcaggctgtcagagtgaggatggacctcaaaagtttgatcccctcgtgcagatgaagaagctgaagcccagagtggggaaggggagtggcccaaggtcacacagctagtttgagtagagccagtcttgggagagccaagtactacagccctgggggtgtcacaccgcttgtcactgcccctgaggtctcctgccaaacaactgcagggagtttggctaacagtcctgtgtccagggtgccggtggggatgttatagatgttgctgggatcctgccctcggctccaaattctggcctctcatcccaggctgcagacccttctgccccatgacaggcctgggtgccacacagaggtggccaccctcccaccacagtgtctgcagctgctgcccttctcccaggcccccagacagaagagaccctgtttcccctcctctcccctgtgacttcacaagagcttgggctaggagtgaaggtcagcatgttctcatgtgctcatcctcttggtttccccaaagaccgggagggtcacggatggggcgtgcagaatccttgtgttttttctcgctgggcagcttgaggggctggggagtattcccagggtctttgctctggagagtccctgcagagccactggctgaggttgggttcagggttcagcggagtcctccatgcttccaaaggccgggaagcacccgcctctctatcgagtcagtgctgtgcgtgtgtgtctgagaatgtgtgtgatgtgtggagtgtgcgtgtgtttgtgtgtgtgtgtgtgtgtgttggggcagaaggaccactctttcctggggatcccttgacccttataactagaagggaccttagggagcatctaagctggtgcccccattgtacaggcgaggtccagagggatggcatctgcccaccccaccccttgccctcttgttgcctgcactcatttcccagggaccctcctaggataggactgccctccttcctggccccctcccgccatcctcccagccacccacataatcaccatctcagcccaactctggtggccctctaggtctccatgcattcttcctgccctagagtagccagctcaccaaggcctttatccccagcccaggagaagggtcagggagggaaggggctgcaccagccctgagacctcaaagacttgggagaaaagccaaaactcctcatgcccaggcccacatgtctgaccaccccagcccaccccgccaccaaggtaaaagcacaacaggagacccccttattaatgggtgaaatgattggggttgtttttttagtcacacagccccatcctcacccctttgccttgctgtctgtctccaccccagcctctgttccccatttgcctctctttcacctccaagcccccaaatgtaacctctagttgcggacgcggttgttctatcaataaagctgcagtgttctagcgctcagcgtcagccgtgtgtgttggcagggcagagtgggccagggtcggggccggggcactggagggctcctctcagctccctgggggcagcctttcttctctttggcacctgtcgacagggatcctgctctgtggcctggacagtgaggacctgcatcctggtctgctcccagtgaacttgtgtgcatttgttcattcagcaaataccaaccaaacactgcctttgtggaagcccctgtttaatgggagagatggacagtaagctaataatgacaccaagacatatataatgatgtgtacagtgagggctgggaagggaaattggtgctatgaaagaaggtatgaagagggttcttatttgggttggggcttcggggaagacttctctaagagacatttaggagagacagaatgattggagttagcctgttgggattgggagaggcttctgagcagagggaacagaatatgcaaaggccaacagggcccaaaaacttagaaggctcaaggaaggggagtaagggcaaaggaggaggactaaagttggtatggtggttgaaatgccattttcccttctcggcacccaaccctaccatccctcctacacgcttggagtcccttccctcttaatctctattctggccctacagaccccaccctgcaccctacttggggctgcctcccttattcaccaccagctagctgcatccttgccctaagatcaagttatgccaacctttccctttaccccagacctctcagaattctagaatttcagagctaggaggtccttaaaggtcacttatttcaaacatctactcatatattgtaggtgagatgggcttgccaaggtcatggggataggcagtgatgagcatttgcaaagtgaccccaaatcaagggtgtggatgtcatgatatggactacatcatatcaggcaaatgacaggaagtgtctttcaggttacttggttacaatgattcaggtaggtcgattgggcagtttcacttccatgttccagatggggaaactgaagctcagattacaagaccaagggctccctctccctaccacctaagttttattggctctcatgttgggtaacttcttgctggcacacctggcctttcttttctaatggaagaggaagggtctaagggactcaccactgctgtaggttggctccctgagcacaggaagagaaatccgctcaagctcactcaagtacaggtgcattattgtgaggacaaacacagtgagggggatgggcactcagaaatccaaacaggagttgcaacagggatggttttcctgaaccagatgggcattttggattcaaggtagctctaggatcatcatctacagaagtttctggtgcttctgtattcttctggtgcttctgtattctacctgtggtagaataaagatggctgcaaatcccatgttatccttcctgtagagaggcagagtctaattcccttcctcttgaatctgggttgctcttagtgccttgtttgtgcaatagaatgtgacatgctgagttgaagatgccttggagcttcagctcaggcctcttggaacgttctctctggaagccctgaactgccacctaggatgtcctctgagttgctctgagaccgtcatgctggaggggctctggctgaccatcccagctgagtccagccttccagccatctccaccaaagcaccagaagatatgggagtgcagctgcctcagaccttccagaccagcctaactgccacctgaattgctcggccaagctctgtccaaattcctgacccatcgtcatgggatataataaaatagttgttttaa

SEQ ID NO: 17047 - DNA, 3021 bp, Homo sapiens
atggaggtgacctgccttctacttctggcgctgatccccttccactgccggggacaaggagtctacgctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatgctgacggtgcaccagacggtgagcgatgtgcgaggcaacttctaccaggagaagacggtgttcctgcgctgtactgtcaactccaacccgcctgcccgcttcatctggaagcggggttccgataccctatcccacagccaggacaatggggttgacatctatgagcccctctacactcagggggagaccaaggtcctgaagctgaagaacctgcggccccaggactatgccagctacacctgccaggtgtctgtgcgtaacgtgtgcggcatcccagacaaggccatcaccttccggctcaccaacaccacggcaccaccagccctgaagctgtctgtgaacgaaactctggtggtgaaccctggggagaatgtgacggtgcagtgtctgctgacaggcggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagttcccgccggaggtggagcccagttcccaggacgtgcgccaggcgctgggccggcccgtgctcctgcgctgctcgctgctgcgaggcagcccccagcgcatcgcctcggctgtgtggcgtttcaaagggcagctgctgccgccgccgcctgttgttcccgccgccgccgaggcgccggatcacgcggagctgcgcctcgacgccgtaactcgcgacagcagcggcagctacgagtgcagcgtctccaacgatgtgggctcggctgcctgcctcttccaggtctccgccaaagcctacagcccggagttttacttcgacacccccaaccccacccgcagccacaagctgtccaagaactactcctacgtgctgcagtggactcagagggagcccgacgctgtcgaccctgtgctcaactacagactcagcatccgccagttgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagcccatcaactctccgaacctttcagacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggctccctcaacctcctggtgcggtcccggaacaaaggggctctggacacgcacgcctggtctctcagtggcaataagggcaatgtgtggcagcaggcccatgtgcccatcagccccagtgggcccttccagattatttttgagggggttcgaggcccgggctacctgggggatattgccatagatgacgtcacactgaagaagggggagtgtccccggaagcagacggatcccaataaaggtgcaagacgggaaggaggtgggggagctgaatctggagggagctgtgcgtggcgggggttcctgtctgttgagggagggtgtttgggtctgaataggggttcagaatgtctgagtgatgggaatcatgtggctctgactgtgtgaaggtgtgccccacactcactcaggctgtgtacttgtgtaaacaatgagaagcctggcccccaccctcgtgatgagcatactgacctgttcacggtatca

SEQ ID NO: 17048 - DNA, 2965 bp, Homo sapiens
tcgagcatctggttattcaagctcctcccacggttcgtattgtgcactcaggcttggcctgtaacattgaagaggagcgctactccgaaagggtctacactatccgggaaggagaaacccttgagttgacttgtctagtcacaggacatccacgtccacagatcaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacagttccacccaatctgactgttccacaggaaaaatcaccattggtcaccagagaaggagacacaatagaactgcaatgtcaagtaactggcaaacctaaaccaatcatcctttggtctagagcggataaagaagttgcaatgcctgatggatcaatgcaaatggagagttatgatggaacactgaggattgtgaatgtatctagggaaatgtcaggaatgtacagatgtcagaccagccaatacaatggatttaacgtgaaaccaagggaagccttggtgcagctcatcgttcagtatccccctgcagtggaaccagcattcttggaaatccggcaaggacaggatcgaagtgtcactatgagttgcagagtactgagagcctatccaatacgggtgctgacctatgagtggcgcttgggcaataaattattacggacgggtcaatttgactctcaggaatacacagagtacgctgtgaagagtctttccaatgaaaactatggggtttataactgtagcatcataaatgaagctggagctgggagatgcagctttcttgttacaggaaaggcctatgctccagaattctattatgatacctacaatccagtatggcagaacagacaccgtgtttattcttacagtctacagtggacacagatgaatcctgatgcagtggatcggattgttgcataccggttgggcatcaggcaggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtgctcctgtaaatcctcatttgagagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgtcttaaatgtttatctacgtttgaaagggcaaacaacaatagagaatccactgtggtcttcaagtgggaataaaggacaaagatggaatgaggctcatgttaatatatacccaattacttcatttcagctcatttttgaaggtatccgaggtcctggaatagaaggtgacattgctattgatgatgtatcaattgcagaaggagaatgtgcaaaacaagacctagcaactaagaattccgttgatggtgctgttgggattttggttcatatatggctttttcccattatcgtcctcatctctatcttaagtcctcgaaggtgaccttatcctggcagaggctataaaagattcaccaggcactggcatgaagaaagagtctttgtaaatggacattgaacaaacaaactaccaaagattcctccactgactactgactcaaaaataaaataataaaaacaaattttttt

SEQ ID NO: 17049 - DNA, 2416 bp, Homo sapiens
aaaataaatgggaatattcaaaagggagaattaattacatataacttgacagagctaattaaaccagaagcttatgaagtccgactgactcctctcaccaaatttggtgaaggagattcaacaattcgtgtgatcaaatatagtggagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgtcttaaatgtttatctacgtttgaaagggcaaacaacaatagagaatccactgtggtcttcaagtgggaataaaggacaaagatggaatgaggctcatgttaatatatacccaattacttcatttcagctcatttttgaaggtatccgaggtcctggaatagaaggtgacattgctattgatgatgtatcaattgcagaaggagaatgtgcaaaacaagacctagcaactaagaattccgttgatggtgctgttgggattttggttcatatatggctttttcccattatcgtcctcatctctatcttaagtcctcgaaggtgaccttatcctggcagaggctataaaagattcaccaggcactggcatgaagaaagagtctttgtaaatggacattgaacaaacaaactaccaaagattcctccactgactactgactcaaaaataaaataataaaaacaaatttttttaagcactggggataaaaagacatcatggaagtataacttattccagactaaacataaaagataatcttgacctgagtagagaagagaccttcaggtgcttttgtggctaaaaagattacagcgtcatctggttgaactctggaaaaaaaaaaaaaaatgaaaaaaagaaaaaaaaaagagctatagaaatccttgtcaaagcacaaagtcatggctggttttgtttcaaatgaatagtttgcttgttaccatggaaacctaatggcctgccaacaaaaacctcactgtaaacagggtacgtgaagagctggcatttattttccttacgagaaggttttcgtagagaattaaataaatgtaggcccttttacctttggctgttacccttccttgaaaataacccgaactcagaattatttaaagcattcatgtttctccccaccttatccccatcccacctttattattattatttttctcccatggctaagctagataactgtatgctgtctctttttgcatgcactactatccaggatggtaaacctgggcttacatgttacacaggcttatcggagtttgcttgcggccacttgaacacccaaactacgtcatctgttccaatgaagaaaccaaaccaccatcttttataaattgccatggaaaccaagtgccttcaatgaaacaagcctgaataattttcaactcagaagcttgcactgctaagagtggtttgtgtaaaactattttataaacaaactacagagcctaaatgtgcaaattacaggcaagacaacaaagccgcttctgaagaagaaaggaccgaagctgctgcgtaagcccatgcagacaagatatttgttgtttaacctcctagacagccatggcctttcggcttattgtccattagaaaatcacttccattgagaccagacatggagcaacactttttttcttccaggttattaaatgggtcaaccagagcaaaaggttattaagaatacttagtgcagaaggtggtaaaacacaaaagtgatttttttactctaacctccatttgaaatgaaattggccctagctttagagggaacaagaaaatgtttgggattgcagtgcatactaactctacagtggaactgggcctgaaaaatctggctttattctaaactctgagggtaatatgcctctgccctttagtcagactctgtgcaaattgtgaaatattattttattattttaccaagattataaaaacacttttacaaaaaaacaaaaacctgtaaaaataattttgagctacctgacgacaaatcatatctttaaccagccagttttccaatgcattgtaaatttcacttaaacctgttggttatgaaaatttgaagatcattttccttaaattatctcagcttttaacttcatttaaaaagacttttgtctaagaagaatattattattatatgttctttcaacaccccaggatt

SEQ ID NO: 17050 - DNA, 5075 bp, Homo sapiens
acttcgcctcgcagctccccttcccatcaccgccccctgctcctccccggcgtctgcgattttcccaggcacccggtgtgagtgcggcgtgcgtgtgagtgtgtgtcagggtattgtgttgtgggagagtgtgtgagtgtgtgtgagtgtgtgtgtgcatgagtgtgtggagtgcggggctcctgcgctccgctcgccgccgccgccggggaaggacagacggacggcgcttcctccttcggcgagcggttcccgggcacctcggcttggcccgggcgcgagtggagcgcgcctggctggccgccggcctcctgaaggtcccgttgcgtaccccctgggctggatatgttcatgttcacgtgaagatggatttactgtacggtctcgtgtggctgctgacagtcctcctggaggggatctctggccaaggagtgtacgctcctcccacggttcgtattgtgcactcaggcttggcctgtaacattgaagaggagcgctactccgaaagggtctacactatccgggaaggagaaacccttgagttgacttgtctagtcacaggacatccacgtccacagatcaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacagttccacccaatctgactgttccacaggaaaaatcaccattggtcaccagagaaggagacacaatagaactgcaatgtcaagtaactggcaaacctaaaccaatcatcctttggtctagagcggataaagaagttgcaatgcctgatggatcaatgcaaatggagagttatgatggaacactgaggattgtgaatgtatctagggaaatgtcaggaatgtacagatgtcagaccagccaatacaatggatttaacgtgaaaccaagggaagccttggtgcagctcatcgttcagtatccccctgcagtggaaccagcattcttggaaatccggcaaggacaggatcgaagtgtcactatgagttgcagagtactgagagcctatccaatacgggtgctgacctatgagtggcgcttgggcaataaattattacggacgggtcaatttgactctcaggaatacacagagtacgctgtgaagagtctttccaatgaaaactatggggtttataactgtagcatcataaatgaagctggagctgggagatgcagctttcttgttacaggaaaggcctatgctccagaattctattatgatacctacaatccagtatggcagaacagacaccgtgtttattcttacagtctacagtggacacagatgaatcctgatgcagtggatcggattgttgcataccggttgggcatcaggcaggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtgctcctgtaaatcctcatttgagagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgtcttaaatgtttatctacgtttgaaagggcaaacaacaatagagaatccactgtggtcttcaagtgggaataaaggacaaagatggaatgaggctcatgttaatatatacccaattacttcatttcagctcatttttgaaggtatccgaggtcctggaatagaaggtgacattgctattgatgatgtatcaattgcagaaggagaatgtgcaaaacaagacctagcaactaagaattccgttgatggtgctgttgggattttggttcatatatggctttttcccattatcgtcctcatctctatcttaagtcctcgaaggtgaccttatcctggcagaggctataaaagattcaccaggcactggcatgaagaaagagtctttgtaaatggacattgaacaaacaaactaccaaagattcctccactgactactgactcaaaaataaaataataaaaacaaatttttttaagcactggggataaaaagacatcatggaagtataacttattccagactaaacataaaagataatcttgacctgagtagagaagagaccttcaggtgcttttgtggctaaaaagattacagcgtcatctggttgaactctggaaaaaaaaaaaaaaatgaaaaaaagaaaaaaaaaagagctatagaaatccttgtcaaagcacaaagtcatggctggttttgtttcaaatgaatagtttgcttgttaccatggaaacctaatggcctgccaacaaaaacctcactgtaaacagggtacgtgaagagctggcatttattttccttacgagaaggttttcgtagagaattaaataaatgtaggcccttttacctttggctgttacccttccttgaaaataacccgaactcagaattatttaaagcattcatgtttctccccaccttatccccatcccacctttattattattatttttctcccatggctaagctagataactgtatgctgtctctttttgcatgcactactatccaggatggtaaacctgggcttacatgttacacaggcttatcggagtttgcttgcggccacttgaacacccaaactacgtcatctgttccaatgaagaaaccaaaccaccatcttttataaattgccatggaaaccaagtgccttcaatgaaacaagcctgaataattttcaactcagaagcttgcactgctaagagtggtttgtgtaaaactattttataaacaaactacagagcctaaatgtgcaaattacaggcaagacaacaaagccgcttctgaagaagaaaggaccgaagctgctgcgtaagcccatgcagacaagatatttgttgtttaacctcctagacagccatggcctttcggcttattgtccattagaaaatcacttccattgagaccagacatggagcaacactttttttcttccaggttattaaatgggtcaaccagagcaaaaggttattaagaatacttagtgcagaaggtggtaaaacacaaaagtgatttttttactctaacctccatttgaaatgaaattggccctagctttagagggaacaagaaaatgtttgggattgcagtgcatactaactctacagtggaactgggcctgaaaaatctggctttattctaaactctgagggtaatatgcctctgccctttagtcagactctgtgcaaattgtgaaatattattttattattttaccaagattataaaaacacttttacaaaaaaacaaaaacctgtaaaaataattttgagctacctgacgacaaatcatatctttaaccagccagttttccaatgcattgtaaatttcacttaaacctgttggttatgaaaatttgaagatcattttccttaaattatctcagcttttaacttcatttaaaaagacttttgtctaagaagaatattattattatatgttctttcaacaccccaggattaaaaaaactgattatgcaagcaattggaatataagtattaaattatagcatttgcaaatattaatataaaagcacaacaaaatgtagtggaaaatgacaaagcttgttttttaaaacaattctgtagaaatgtttgtgcaaattcagtaattcaacttaaaatataattttacagctatgttcaataaagcctctttccaggtaaggta

SEQ ID NO: 17051 - DNA, 5239 bp, Homo sapiens
gaaaaaaacaaacaaacaaaaaaaatcaccattccttttaatagcttgagcctgtaccagaatgataagtggaaattagtcctcaaagtaacctcagctgtttcattattgtgtgcctcgagcatctggttattcaagctcctcccacggttcgtattgtgcactcaggcttggcctgtaacattgaagaggagcgctactccgaaagggtctacactatccgggaaggagaaacccttgagttgacttgtctagtcacaggacatccacgtccacaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacagttccacccaatctgactgttccacaggaaaaatcaccattggtcaccagagaaggagacacaatagaactgcaatgtcaagtaactggcaaacctaaaccaatcatcctttggtctagagcggataaagaagttgcaatgcctgatggatcaatgcaaatggagagttatgatggaacactgaggattgtgaatgtatctagggaaatgtcaggaatgtacagatgtcagaccagccaatacaatggatttaacgtgaaaccaagggaagccttggtgcagctcatcgttcagtatccccctgcagtggaaccagcattcttggaaatccggcaaggacaggatcgaagtgtcactatgagttgcagagtactgagagcctatccaatacgggtgctgacctatgagtggcgcttgggcaataaattattacggacgggtcaatttgactctcaggaatacacagagtacgctgtgaagagtctttccaatgaaaactatggggtttataactgtagcatcataaatgaagctggagctgggagatgcagctttcttgttacaggaaaggcctatgctccagaattctattatgatacctacaatccagtatggcagaacagacaccgtgtttattcttacagtctacagtggacacagatgaatcctgatgcagtggatcggattgttgcataccggttgggcatcaggcaggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtgctcctgtaaatcctcatttgagagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgtcttaaatgtttatctacgtttgaaagggcaaacaacaatagagaatccactgtggtcttcaagtgggaataaaggacaaagatggaatgaggctcatgttaatatatacccaattacttcatttcagctcatttttgaaggtatccgaggtcctggaatagaaggtgacattgctattgatgatgtatcaattgcagaaggagaatgtgcaaaacaagacctagcaactaagaattccgttgatggtgctgttgggattttggttcatatatggctttttcccattatcgtcctcatctctatcttaagtcctcgaaggtgaccttatcctggcagaggctataaaagattcaccaggcactggcatgaagaaagagtctttgtaaatggacattgaacaaacaaactaccaaagattcctccactgactactgactcaaaaataaaataataaaaacaaatttttttaagcactggggataaaaagacatcatggaagtataacttattccagactaaacataaaagataatcttgacctgagtagagaagagaccttcaggtgcttttgtggctaaaaagattacagcgtcatctggttgaactctggaaaaaaaaaaaaaaatgaaaaaaagaaaaaaaaaagagctatagaaatccttgtcaaagcacaaagtcatggctggttttgtttcaaatgaatagtttgcttgttaccatggaaacctaatggcctgccaacaaaaacctcactgtaaacagggtacgtgaagagctggcatttattttccttacgagaaggttttcgtagagaattaaataaatgtaggcccttttacctttggctgttacccttccttgaaaataacccgaactcagaattatttaaagcattcatgtttctccccaccttatccccatcccacctttattattattatttttctcccatggctaagctagataactgtatgctgtctctttttgcatgcactactatccaggatggtaaacctgggcttacatgttacacaggcttatcggagtttgcttgcggccacttgaacacccaaactacgtcatctgttccaatgaagaaaccaaaccaccatcttttataaattgccatggaaaccaagtgccttcaatgaaacaagcctgaataattttcaactcagaagcttgcactgctaagagtggtttgtgtaaaactattttataaacaaactacagagcctaaatgtgcaaattacaggcaagacaacaaagccgcttctgaagaagaaaggaccgaagctgctgcgtaagcccatgcagacaagatatttgttgtttaacctcctagacagccatggcctttcggcttattgtccattagaaaatcacttccattgagaccagacatggagcaacactttttttcttccaggttattaaatgggtcaaccagagcaaaaggttattaagaatacttagtgcagaaggtggtaaaacacaaaagtgatttttttactctaacctccatttgaaatgaaattggccctagctttagagggaacaagaaaatgtttgggattgcagtgcatactaactctacagtggaactgggcctgaaaaatctggctttattctaaactctgagggtaatatgcctctgccctttagtcagactctgtgcaaattgtgaaatattattttattattttaccaagattataaaaacacttttacaaaaaaacaaaaacctgtaaaaataattttgagctacctgacgacaaatcatatctttaaccagccagttttccaatgcattgtaaatttcacttaaacctgttggttatgaaaatttgaagatcattttccttaaattatctcagcttttaacttcatttaaaaagacttttgtctaagaagaatattattattatatgttctttcaacaccccaggattaaaaaaactgattatgcaagcaattggaatataagtattaaattatagcatttgcaaatattaatataaaagcacaacaaaatgtagtggaaaatgacaaagcttgttttttaaaacaattctgtagaaatgtttgtgcaaattcagtaattcaacttaaaatataattttacagctatgttcaataaagcctctttccaggtaaggtatgacaagcagtatgtgtgtttgttgagcaatgttcacttatcactaaaatgaaattagttatacaatttattggttaccatgggataaatcttcagtgctccacataccttaatgtctgcagaaagaaattttaataggaactccctgatgcactcccctatattgtaatacatgcagaaagcagttaaacctttgaaggtaaaatatgaaacatatatgaacctggaatttaatgtctattttcagtcagttcaaaaggggaccagtttgaatatttaggtagtgatggaattgatctgaaccaagtcctttaaattaaacataataaacaaatgagtttcataacttatttgaatgaattagacatcttaaaattttttcagagtttcacagtaacccatatactttatcagaccaaagagattcaagtacacaatatctggggcatttcttttacgttttacaaaa

SEQ ID NO: 17052 - DNA, 5179 bp, Homo sapiens
atggatttactgtacggtctcgtgtggctgctgacagtcctcctggaggggatctctggccaaggagtgtacgctcctcccacggttcgtattgtgcactcaggcttggcctgtaacattgaagaggagcgctactccgaaagggtctacactatccgggaaggagaaacccttgagttgacttgtctagtcacaggacatccacgtccacagatcaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacagttccacccaatctgactgttccacaggaaaaatcaccattggtcaccagagaaggagacacaatagaactgcaatgtcaagtaactggcaaacctaaaccaatcatcctttggtctagagcggataaagaagttgcaatgcctgatggatcaatgcaaatggagagttatgatggaacactgaggattgtgaatgtatctagggaaatgtcaggaatgtacagatgtcagaccagccaatacaatggatttaacgtgaaaccaagggaagccttggtgcagctcatcgttcagtatccccctgcagtggaaccagcattcttggaaatccggcaaggacaggatcgaagtgtcactatgagttgcagagtactgagagcctatccaatacgggtgctgacctatgagtggcgcttgggcaataaattattacggacgggtcaatttgactctcaggaatacacagagtacgctgtgaagagtctttccaatgaaaactatggggtttataactgtagcatcataaatgaagctggagctgggagatgcagctttcttgttacaggaaaggcctatgctccagaattctattatgatacctacaatccagtatggcagaacagacaccgtgtttattcttacagtctacagtggacacagatgaatcctgatgcagtggatcggattgttgcataccggttgggcatcaggcaggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtgctcctgtaaatcctcatttgagagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgtcttaaatgtttatctacgtttgaaagggcaaacaacaatagagaatccactgtggtcttcaagtgggaataaaggacaaagatggaatgaggctcatgttaatatatacccaattacttcatttcagctcatttttgaaggtatccgaggtcctggaatagaaggtgacattgctattgatgatgtatcaattgcagaaggagaatgtgcaaaacaagacctagcaactaagaattccgttgatggtgctgttgggattttggttcatatatggctttttcccattatcgtcctcatctctatcttaagtcctcgaaggtgaccttatcctggcagaggctataaaagattcaccaggcactggcatgaagaaagagtctttgtaaatggacattgaacaaacaaactaccaaagattcctccactgactactgactcaaaaataaaataataaaaacaaatttttttaagcactggggataaaaagacatcatggaagtataacttattccagactaaacataaaagataatcttgacctgagtagagaagagaccttcaggtgcttttgtggctaaaaagattacagcgtcatctggttgaactctggaaaaaaaaaaaaaaatgaaaaaaagaaaaaaaaaagagctatagaaatccttgtcaaagcacaaagtcatggctggttttgtttcaaatgaatagtttgcttgttaccatggaaacctaatggcctgccaacaaaaacctcactgtaaacagggtacgtgaagagctggcatttattttccttacgagaaggttttcgtagagaattaaataaatgtaggcccttttacctttggctgttacccttccttgaaaataacccgaactcagaattatttaaagcattcatgtttctccccaccttatccccatcccacctttattattattatttttctcccatggctaagctagataactgtatgctgtctctttttgcatgcactactatccaggatggtaaacctgggcttacatgttacacaggcttatcggagtttgcttgcggccacttgaacacccaaactacgtcatctgttccaatgaagaaaccaaaccaccatcttttataaattgccatggaaaccaagtgccttcaatgaaacaagcctgaataattttcaactcagaagcttgcactgctaagagtggtttgtgtaaaactattttataaacaaactacagagcctaaatgtgcaaattacaggcaagacaacaaagccgcttctgaagaagaaaggaccgaagctgctgcgtaagcccatgcagacaagatatttgttgtttaacctcctagacagccatggcctttcggcttattgtccattagaaaatcacttccattgagaccagacatggagcaacactttttttcttccaggttattaaatgggtcaaccagagcaaaaggttattaagaatacttagtgcagaaggtggtaaaacacaaaagtgatttttttactctaacctccatttgaaatgaaattggccctagctttagagggaacaagaaaatgtttgggattgcagtgcatactaactctacagtggaactgggcctgaaaaatctggctttattctaaactctgagggtaatatgcctctgccctttagtcagactctgtgcaaattgtgaaatattattttattattttaccaagattataaaaacacttttacaaaaaaacaaaaacctgtaaaaataattttgagctacctgacgacaaatcatatctttaaccagccagttttccaatgcattgtaaatttcacttaaacctgttggttatgaaaatttgaagatcattttccttaaattatctcagcttttaacttcatttaaaaagacttttgtctaagaagaatattattattatatgttctttcaacaccccaggattaaaaaaactgattatgcaagcaattggaatataagtattaaattatagcatttgcaaatattaatataaaagcacaacaaaatgtagtggaaaatgacaaagcttgttttttaaaacaattctgtagaaatgtttgtgcaaattcagtaattcaacttaaaatataattttacagctatgttcaataaagcctctttccaggtaaggtatgacaagcagtatgtgtgtttgttgagcaatgttcacttatcactaaaatgaaattagttatacaatttattggttaccatgggataaatcttcagtgctccacataccttaatgtctgcagaaagaaattttaataggaactccctgatgcactcccctatattgtaatacatgcagaaagcagttaaacctttgaaggtaaaatatgaaacatatatgaacctggaatttaatgtctattttcagtcagttcaaaaggggaccagtttgaatatttaggtagtgatggaattgatctgaaccaagtcctttaaattaaacataataaacaaatgagtttcataacttatttgaatgaattagacatcttaaaattttttcagagtttcacagtaacccatatactttatcagaccaaagagattcaagtacacaatatctggggcatttcttttacgttttacaaaa

SEQ ID NO: 17053 - DNA, 2440 bp, Homo sapiens
gccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaaaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaaagcaaattctccacttgagggtttgcccatcattcaaacactattccagaaaataatgaaaaaaaaatgtgggatttattttagcacctctgagtggactgtacttttctcaacggaaaaaaaaaatgcccttggtccttgagacaaaagatttaatatacaaccatgtggcctcaggctgaccagatcaaagtggtttctaatccattctacatgtcaagtttaaatgaaccagactgcctgtgactttatgaatctgaaggtattacctgttgctgctttcttaaccaccatgagtaggtaaagcaaataataactcacagagtgtggatttttgagaatctgaatgttttctcattcacaaaagtatcccttctacccctatctggcgcagggctgaaatgtcatcattagaggttctgtcttctggggcttacaagttctatgtttcttaaaattcgctgattaaaaattttaaaaagataggatcacacctgaaagcagtggtcccagctctgtgctgtgggacatcacaggtcctaaacagtgatagagaaagggctggggagtggcagctggaatctctgcttccgtctgaacatctggacacacatgtcagagaatctttgcattaaatggactgcccgatctatttggtgattaaatggctgtgcggtgaggggagaaccctgggcagtctggagactgaggtgccattctcggctagagacaccacccaaagaagagatgggctggctactaaagacaagtgtcagttgaataaatgtctttaaacct

SEQ ID NO: 17054 - DNA, 4015 bp, Homo sapiens
agagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccactttctcaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaaca

SEQ ID NO: 17055 - DNA, 4407 bp, Homo sapiens
acacacagagtgatacaaatacctgcttgagcccctcagttattttctctcaagggctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagtgtgtgggctccccaagttctcccggaagctgatggccaggatcttcaatggacgcccagcccagaaaggcaccactccctggattgccatgctgtcacacctgaatgggcagcccttctgcggaggctcccttctaggctccagctggatcgtgaccgccgcacactgcctccaccagtcactcgatccggaagatccgaccctacgtgattcagacttgctcagcccttctgacttcaaaatcatcctgggcaagcattggaggctccggtcagatgaaaatgaacagcatctcggcgtcaaacacaccactctccacccccagtatgatcccaacacattcgagaatgacgtggctctggtggagctgttggagagcccagtgctgaatgccttcgtgatgcccatctgtctgcctgagggaccccagcaggaaggagccatggtcatcgtcagcggctgggggaagcagttcttgcaaaggttcccagagaccctgatggagattgaaatcccgattgttgaccacagcacctgccagaaggcttatgccccgctgaagaagaaagtgaccagggacatgatctgtgctggggagaaggaagggggaaaggacgcctgtgcgggtgactctggaggccccatggtgaccctgaatagagaaagaggccagtggtacctggtgggcactgtgtcctggggtgatgactgtgggaagaaggaccgctacggagtatactcttacatccaccacaacaaggactggatccagagggtcaccggagtgaggaactgaatttggctcctcagccccagcaccaccagctgtgggcagtcagtagcagaggacgatcctccgatgaaagcagccatttctcctttccttcctcccatcccccctccttcggcctatccattactgggcaatagagcaggtatcttcacccccttttcactctctttaaagagatggagcaagagagtggtcagaacacaggccgaatccaggctctatcacttactagtttgcagtgctgggcaggtgacttcatctcttcgaacttcagtttcttcataagatggaaatgctataccttacctacctcgtaaaagtctgatgaggaaaagattaactaatagatgcatagcacttaacagagtgcatagcatacactgttttcaataaatgcaccttagcagaaggtcgatgtgtctaccaggcagacgaagctctcttacaaacccctgcctgggtcttagcattgatcagtgacacacctctcccctcaaccttgaccatctccatctgcccttaaatgctgtatgcttttttgccaccgtgcaacttgcccaacatcaatcttcaccctcatccctaaaaaagtaaaacagacaaggttctgagtcctgtggtatgtcccctagcaaatgtaactaggaacatgcactagatgacagattgcgggagggcctgagagaagcagggacaggagggagcctggggattgtggtttgggaaggcagacacctggttctagaactagctctgcccttagccccctgtatgaccctatgcaagtcctcctccctcatctcaaagggtcctcaaagctctgacgatctaagatacaatgaagccattttccccctgataagatgaggtaaagccaatgtaaccaaaaggcaaaaattacaatcggttcaaaggaactttgatgcagacaaaatgctgctgctgctgctcctgaaatacccacccctttccactacgggtgggttcccaaggacatgggacaggcaaagtgtgagccaaaggatccttccttattcctaagcagagcatctgctctgggccctggcctccttcccttcttgggaaactgggctgcatgaggtgggccctggtagtttgtaccccaggcccctatactcttccttcctatgtccacagctgaccccaagcagccgttccccgactcctcacccctgagcctcaccctgaactccctcatcttgcaaggccataagtgttttccaagcaaaatgcctctcccatcctctctcaggaagcttctagagactttatgccctccagagctccaagatataagccctccaagggatcagaagctccaagttcctgtcttctgttttatagaaattgatcttccctgggggactttaactcttgacctgtatgcagctgttggagtaattccaggtctcttgaaaaaaaagaggaagataatggagaatgagaacatatatatatatatattaagccccaggctgaatactcagggacagcaattcacagcctgcctctggttctataaacaagtcattctacctctttgtgccctgctgtttattctgtaaggggaaggtggcaatgggacccagctccatcagacacttgtcaagctagcagaaactccattttcaatgccaaagaagaactgtaatgctgttttggaatcatcccaaggcatcccaagacaccatatcttcccatttcaagcactgcctgggcacaccccaacatcccaggctgtggtggctcctgtgggaactacctagatgaagagagtatcatttataccttctaggagctcctattgggagacatgaaacatatgtaattgactaccatgtaatagaacaaaccctgccaagtgctgctttggaaagtcatggaggtaaaagaaagacc

SEQ ID NO: 17056 - DNA, 3900 bp, Homo sapiens
tctctcaagggctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccactttctcaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaa

SEQ ID NO: 17057 - DNA, 2428 bp, Homo sapiens
aaagataaggcatcacggacaccacaccgggcacgagctcacaggcaagtcaagctgggaggaccaaggccgggcagccgggagcacccaaggcaggaaaatgaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactg

SEQ ID NO: 17058 - DNA, 2169 bp, Homo sapiens
acacacagagtgatacaaatacctgcttgagcccctcagttattttctctcaagggctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctcctggtggccggctggggcatctccaatcccaatgtgacagt

SEQ ID NO: 17059 - DNA, 2439 bp, Homo sapiens
gctggacgggcacaccatgaggctgctgaccctcctgggccttctgtgtggctcggtggccacccccttgggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgaggacattgacgagtgccaggtggccccgggagaggcgcccacctgcgaccaccactgccacaaccacctgggcggtttctactgctcctgccgcgcaggctacgtcctgcaccgtaacaagcgcacctgctcagccctgtgctccggccaggtcttcacccagaggtctggggagctcagcagccctgaatacccacggccgtatcccaaactctccagttgcacttacagcatcagcctggaggaggggttcagtgtcattctggactttgtggagtccttcgatgtggagacacaccctgaaaccctgtgtccctacgactttctcaagattcaaacagacagagaagaacatggcccattctgtgggaagacattgccccacaggattgaaacaaaaagcaacacggtgaccatcacctttgtcacagatgaatcaggagaccacacaggctggaagatccactacacgagcacagcgcagccttgcccttatccgatggcgccacctaatggccacgtttcacctgtgcaagccaaatacatcctgaaagacagcttctccatcttttgcgagactggctatgagcttctgcaaggtcacttgcccctgaaatcctttactgcagtttgtcagaaagatggatcttgggaccggccaatgcccgcgtgcagcattgttgactgtggccctcctgatgatctacccagtggccgagtggagtacatcacaggtcctggagtgaccacctacaaagctgtgattcagtacagctgtgaagagaccttctacacaatgaaagtgaatgatggtaaatatgtgtgtgaggctgatggattctggacgagctccaaaggagaaaaatcactcccagtctgtgagcctgtttgtggactatcagcccgcacaacaggagggcgtatatatggagggcaaaaggcaaaacctggtgattttccttggcaagtcctgatattaggtggaaccacagcagcaggtgcacttttatatgacaactgggtcctaacagctgctcatgccgtctatgagcaaaaacatgatgcatccgccctggacattcgaatgggcaccctgaaaagactatcacctcattatacacaagcctggtctgaagctgtttttatacatgaaggttatactcatgatgctggctttgacaatgacatagcactgattaaattgaataacaaagttgtaatcaatagcaacatcacgcctatttgtctgccaagaaaagaagctgaatcctttatgaggacagatgacattggaactgcatctggatggggattaacccaaaggggttttcttgctagaaatctaatgtatgtcgacataccgattgttgaccatcaaaaatgtactgctgcatatgaaaagccaccctatccaaggggaagtgtaactgctaacatgctttgtgctggcttagaaagtgggggcaaggacagctgcagaggtgacagcggaggggcactggtgtttctagatagtgaaacagagaggtggtttgtgggaggaatagtgtcctggggttccatgaattgtggggaagcaggtcagtatggagtctacacaaaagttattaactatattccctggatcgagaacataattagtgatttttaacttgcgtgtctgcagtcaaggattcttcatttttagaaatgcctgtgaagaccttggcagcgacgtggctcgagaagcattcatcattactgtggacatggcagttgttgctccacccaaaaaaacagactccaggtgaggctgctgtcatttctccacttgccagtttaattccagccttacccattgactcaaggggacataaaccacgagagtgacagtcatctttgcccacccagtgtaatgtcactgctcaaattacatttcattaccttaaaaagccagtctcttttcatactggctgttggcatttctgtaaactgcctgtccatgctctttgtttttaaacttgttcttattga

SEQ ID NO: 17060 - DNA, 726 bp, Homo sapiens
ggccaggccagctggacgggcacaccatgaggctgctgaccctcctgggccttctgtgtggctcggtggccacccccttgggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgaggacattgacgagtgccaggtggccccgggagaggcgcccacctgcgaccaccactgccacaaccacctgggcggtttctactgctcctgccgcgcaggctacgtcctgcaccgtaacaagcgcacctgctcagagcagagcctctagcctcccctggagctccggcctgcccagcaggtcagaagccagagccagcctgctggcctcagctccgggttgggctgagatggctgtgccccaactcccattcacccaccatggacccaataataaacctggccccacccca

SEQ ID NO: 17061 - DNA, 1605 bp, Homo sapiens
ctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagacggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgag

SEQ ID NO: 17062 - DNA, 3051 bp, Homo sapiens
cgggggctgccgggaaaggcatacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgaggctgtggggtaatgagcactcagcctttggggtacctgttcctaaagtgggccaaaagagccctccctacatgatgccccagtttttgctttattcctatttcatacagcttctcgggggagtgagcaggctacactccagaacaccggtatgggaaggagtgggagaggaagccagctttggcctcacaggcacagcttgcaagcaggccttgggtctgcccagaggcacagcttgcaagcagccctacagagaaggtgactcaaaggatacaccagtcaccagtgcaagactcttcgctcctgtttttctcttttttttttttttgagacggagtctcggtctgtagcccaggctggagtgcagtggcacgatctcggctcattgcaagctccgcctcccgggttcacgccactcttctgcctcagcctcccaagtagctgggaccacaggcgcccaccaccacgcccagccaatttttttggtatttttagtagagatggggtttcactgtgttagccaggatggtctcgatcttctgacctcgtgatccgcccacctcagcctcccaaagtgctgggattacaggcgtgagccaccacgcctggcccggctcctgtttttcaactggccctagaggaggggtccgcaaaccaggctggcaggccagttctggccatacctgttcatttccatactgtctggctgctttcaagccacagtggcaaagttgaagagttgcactagactgtacggcctgcaaaactgaaaccattgactgtcaaccacttctctacaacatactcaactgttgcagattacagggactcaggaaccgaattagacaattttcatggcgaggagaagcccagttagctttcctaaacgggcaggaagtgtgaaggagggaatctcctgatgccctgctccaggggtggcacacacctgcaagaggctgtcggctgtctgctgctgctgaggtttctgacctgcaatcgtagatcctgtcaccacagactaatcacttagtccactggctccttcctgtgggataaaggtttaaattcatgcaaaagaatctttctgggcttctgcccacactagagtccctatacaatggagttccaggaaaccaccttcaaaaatctcctgggttttcttgcctccaaattttcttcagctaaaaaacaataaagatgagctggaaagaaaaggtctgctaaagggaa

SEQ ID NO: 17063 - DNA, 1587 bp, Homo sapiens
tgcttaatcctggtgcagggggcgagcatggccgctccgcgaggtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttg

SEQ ID NO: 17064 - DNA, 1523 bp, Homo sapiens
atacgtgcttaatcctggtgcagggggcgagcatggccgctccgcgagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagc

SEQ ID NO: 17065 - DNA, 5171 bp, Homo sapiens
gggaacttggattaggtggagaggcagttggggggcctcgttgttttgcgtcttagttccgccctcctgtccatcaggagaaggaaaggataaaccctgggccatgaggctacccctgctcctggtttttgcctctgtcattccgggtgctgttctcctactggacaccaggcaatttttaatctataatgaagatcacaagcgctgcgtggatgcagtgagtcccagtgccgtccaaaccgcagcttgcaaccaggatgccgaatcacagaaattccgatgggtgtccgaatctcagattatgagtgttgcatttaaattatgcctgggagtgccatcaaaaacagactgggttgctatcactctctatgcctgtgactcaaaaagtgaatttcagaaatgggagtgcaaaaatgacacacttttggggatcaaaggagaagatttattttttaactacggcaacagacaagaaaagaatattatgctctacaagggatcgggtttatggagcaggtggaagatctatggaaccacagacaatctgtgctccagaggttatgaagccatgtatacgctactaggcaatgccaatggagcaacctgtgcattcccgttcaagtttgaaaacaagtggtacgcagattgcacgagtgctgggcggtcggatggatggctctggtgcggaaccactactgactatgacacagacaagctatttggatattgtccattgaaatttgagggcagtgaaagcttatggaataaagacccgctgaccagcgtttcctaccagataaactccaaatccgctttaacgtggcaccaagcgaggaaaagctgccaacaacagaacgctgagctcctgagcatcacagagatacatgagcaaacatacctgacaggattaaccagttccttgacctcaggactctggattggacttaacagtctgagcttcaacagcggttggcagtggagtgaccgcagtcctttccgatatttgaactggttaccaggaagtccatcagctgaacctggaaaaagctgtgtgtcactaaatcctggaaaaaatgctaaatgggaaaatctggaatgtgttcagaaactgggctatatttgcaaaaagggcaacaccactttaaattcttttgttattccctcagaaagtgatgtgcctactcactgtcctagtcagtggtggccgtatgccggtcactgttacaagattcacagagatgagaaaaaaatccagagggatgctctgaccacctgcaggaaggaaggcggtgacctcacaagtatccacaccatcgaggaattggactttattatctcccagctaggatatgagccaaatgacgaattgtggatcggcttaaatgacattaagattcaaatgtactttgagtggagtgatgggacccctgtaacgtttaccaaatggcttcgtggagaaccaagccatgaaaacaacagacaggaggattgtgtggtgatgaaaggcaaggatgggtactgggcagatcggggctgtgagtggcctcttggctacatctgcaagatgaaatcacgaagccaaggtccagaaatagtggaagtcgaaaaaggctgcaggaaaggctggaaaaaacatcacttttactgctatatgattggacatacgctttcaacatttgcagaagcaaaccaaacctgtaataatgagaatgcttatttaacaactattgaagacagatatgaacaagccttcctgactagtttcgttggcttaaggcctgaaaaatatttctggacaggactttcagatatacaaaccaaagggacttttcagtggaccatcgaggaagaggttcggttcacccactggaattcagatatgccagggcgaaagccagggtgtgttgccatgagaaccgggattgcagggggcttatgggatgttttgaaatgtgatgaaaaggcaaaatttgtgtgcaagcactgggcagaaggagtaacccacccaccgaagcccacgacgactcccgaacccaaatgtccggaggattggggcgccagcagtagaacaagcttgtgtttcaagctgtatgcaaaaggaaaacatgagaagaaaacgtggtttgaatctcgagatttttgtcgagctctgggtggagacttagctagcatcaataacaaagaggaacagcaaacaatatggcgattaataacagctagtggaagctaccacaaactgttttggttgggattgacatatggaagcccttcagaaggttttacttggagtgatggttctcctgtttcatatgaaaactgggcttatggagaacctaataattatcaaaatgttgaatactgtggtgagctgaaaggtgaccctactatgtcttggaatgatattaattgtgaacaccttaacaactggatttgccagatacaaaaaggacaaacaccaaaacctgagccaacaccagctcctcaagacaatccaccagttactgaagatgggtgggttatttacaaagactaccagtattatttcagcaaagagaaggaaaccatggacaatgcgcgagcgttttgcaagaggaattttggtgatcttgtttctattcaaagtgaaagtgaaaagaagtttctatggaaatatgtaaacagaaatgatgcacagtctgcatattttattggtttattgatcagcttggataaaaagtttgcttggatggatggaagcaaagtggattacgtgtcttgggccacaggtgaacccaattttgcaaatgaagatgaaaactgtgtgaccatgtattcaaattcagggttttggaatgacattaactgtggctatccaaacgccttcatttgccagcgacataacagtagtatcaatgctaccacagttatgcctaccatgccctcggtcccatcagggtgcaaggaaggttggaatttctacagcaacaagtgtttcaaaatctttggatttatggaagaagaaagaaaaaattggcaagaggcacgaaaagcttgtataggctttggagggaatctggtctccatacaaaatgaaaaagagcaagcatttcttacctatcacatgaaggactccactttcagtgcctggactgggctgaatgatgtcaattcagaacacacgttcctttggacggatggacgaggagtccattacacaaactgggggaaaggttaccctggtggaagaagaagcagtctttcttatgaagatgctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcatcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctagtacctcaatgcgattctgagatatttgaatttcataaaattgtaactgaaatttaaaatttttagttcaatgtgattgttttctttaaaatgagtactgaattgtactggtctgtccttttttcctttgcctaattgaagaaataattgcttgttttctagcctggcaagatattttcataaaagagggataacaatgctgattactaccttttaaaatattttagataaatgcacagcaccacagcaccacatctaagcattagtgatgggtagctgatgtcagcttcatgtggattttaagcactctagaaacaatgaagcttcttggcatattttaaggagctcccaaaatgtgttacctattaaattgtaactcagcaagtagaagaccatttgaaaagtcaggtacaaatttcctcaagtggcataaaaatgtagtcagttttctcttttaccagtttttatttccactccaattatttagaactttatttgtacatgtgcagaagaataaggcagctgagaatcttgtttcccccaagagagttttacaggctgagtgttgcaaatgtgttctttgtcctgttatatgtatatcaggaatacaaggatgtgaaataaaactgtaaatttgcataactggatgtacttagataatgtgaaataaacattaaagacaaggtctatttttaata

SEQ ID NO: 17066 - DNA, 5983 bp, Homo sapiens
gaaggcgaggcggggagagactgggaaacagagcagcaagagaaagggcgcacgctggggtcctcctggacccggcgtgtcctcctctccgccacccctttctctccctcccgacgctctagccccagacccgcgcctcctccccttcccctcccacgctgcccacttcccttcccctctacccctcgaaccctcctccccggttctgcgctcctccctccgccctccctccgcccgggctgcctcctccctcctcctccccgggaggcatcacttcgtcccgacccggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccggaacccaacgtcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgctggcattgtcgtacactgggtgaccagctgtccttgctcctgggggcccgcaccagcaacatatccaagcctggcacccttgagcgtggtgaccagacccgcagtggccagtggcgcatctacggcagcgaggaggacctatgtgctctgccctaccacgaggtctacaccatccagggaaactcccacggaaagccgtgcaccatccccttcaaatatgacaaccagtggttccacggctgcaccagcacgggccgcgaggatggtcacctgtggtgtgccaccacccaggactacggcaaagacgagcgctggggcttctgccccatcaagagtaacgactgcgagaccttctgggacaaggaccagctgactgacagctgctaccagtttaacttccagtccacgctgtcgtggagggaggcctgggccagctgcgagcagcagggtgcggatctgctgagcatcacggagatccacgagcagacctacatcaacggcctcctcactgggtacagctccaccctgtggatcggcttgaatgacttggacacgagcggaggctggcagtggtcggacaactcgcccctcaagtacctcaactgggagagtgaccagccggacaaccccagtgaggagaactgtggagtgatccgcactgagtcctcgggcggctggcagaaccgtgactgcagcatcgcgctgccctatgtgtgcaagaagaagcccaacgccacggccgagcccacccctccagacaggtgggccaatgtgaaggtggagtgcgagccgagctggcagcccttccagggccactgctaccgcctgcaggccgagaagcgcagctggcaggagtccaagaaggcatgtctacggggcggtggcgacctggtcagcatccacagcatggcggagctggaattcatcaccaagcagatcaagcaagaggtggaggagctgtggatcggcctcaacgatttgaaactgcagatgaattttgagtggtctgacgggagccttgtgagcttcacccactggcacccctttgagcccaacaacttccgggacagtctggaggactgtgtcaccatctggggcccggaaggccgctggaacgacagtccctgtaaccagtccttgccatccatctgcaagaaggcaggccagctgagccagggggccgccgaggaggaccatggctgccggaagggttggacgtggcacagcccatcctgctactggctgggagaagaccaagtgacctacagtgaggcccggcgcctgtgcactgaccatggctctcagctggtcaccatcaccaacaggttcgagcaggccttcgtcagcagcctcatctacaactgggagggcgagtacttctggacggccctgcaggacctcaacagcaccggctccttcttctggctcagtggggatgaagtcatgtacacccactggaaccgggaccagcccgggtacagccgtgggggctgcgtggcgctggccactggcagcgccatggggctgtgggaggtgaagaactgtacctcgttccgggcccgctacatctgccggcagagcctgggcactccagtgacgccggagctgccggggccagatcccacgcccagcctcactggctcctgtccccagggctgggcctcggacaccaaactccggtattgctataaggtgttcagctcagagcggctgcaggacaagaagagctgggtccaggcccagggggcctgccaggagctgggggcccagctgctgagcctggccagctacgaggaggagcactttgtggccaacatgctcaacaagatcttcggtgaatcagaacccgagatccacgagcagcactggttctggatcggcctgaaccgtcgggatcccagagggggtcagagttggcgctggagcgacggcgtagggttctcttaccacaatttcgaccggagccggcacgacgacgacgacatccgaggctgtgcggtgctggacctggcctccctgcagtgggtggccatgcagtgcgacacacagctggactggatctgcaagatccccagaggtacggacgtgcgggagcccgacgacagccctcaaggccgacgggaatggctgcgcttccaggaggccgagtacaagttctttgagcaccactccacgtgggcgcaggcgcagcgcatctgcacgtggttccaggccgagctgacctcggtgcacagccaggcggagctagacttcctgagccacaacttgcagaagttctcccgggcccaggagcagcactggtggatcggcctgcacacctctgagagcgatgggcgcttcagatggacagatggttccattataaacttcatctcctgggcaccaggcaaacctcggcctgtcggcaaggacaagaagtgcgtgtacatgacagccagccgagaggactggggggaccagaggtgcctgacagccttgccctacatctgcaagcgcagcaacgtcaccaaagaaacgcagcccccagacctgccaactacagccctggggggctgcccctctgactggatccagttcctcaacaagtgttttcaggtccagggccaggaaccccagagccgggtgaagtggtcagaggcacagttctcctgtgaacagcaagaggcccagctggtcaccatcacaaaccccttagagcaagcattcatcacagccagcctgcccaatgtgacctttgacctttggattggcctccatgcctcgcagagggacttccagtgggtggagcaggagcctttgatgtatgccaactgggcacctggggagccctctggccctagccctgctcccagtggcaacaaaccgaccagctgtgcagtggtcctgcacagcccctcagcccacttcactggccgctgggacgatcggagctgcacggaggagacccatggcttcatctgccagaagggcacggacccctccctgagcccgtccccagcagcgctgccccccgccccgggcactgagctctcctacctcaacggcaccttccggctgcttcagaagccgctgcgctggcacgatgccctcctgctgtgtgagagccgcaatgccagcctggcctacgtgcccgacccctacacccaggccttcctcacgcaggctgcccgagggctgcgcacgccgctctggattgggctggctggcgaggagggctctcggcggtactcctgggtctcagaggagccgctgaactacgtgggctggcaggacggggagccgcagcagccggggggctgtacctacgtagatgtggacggggcctggcgcaccaccagctgtgacaccaagctgcagggggctgtgtgtggggttagcagtgggccccctcctccccgaagaataagctaccatggcagctgtccccagggactggcagactccgcgtggattcccttccgggagcactgctattctttccacatggagctgctgctgggccacaaggaggcgcgacagcgctgccagagagcgggtggggccgtcctgtctatcctggatgagatggagaatgtgtttgtctgggagcacctgcagagctatgagggccagagtcggggcgcctggctgggcatgaacttcaaccccaaaggaggcactctggtctggcaggacaacacagctgtgaactactccaactgggggcccccgggcttgggccccagcatgctgagccacaacagctgctactggattcagagcaacagcgggctatggcgccccggcgcttgcaccaacatcaccatgggtgtcgtctgcaagcttcctcgtgctgagcagagcagcttctccccatcagcgcttccagagaacccagcggccctggtggtggtgctgatggcggtgctgctgctcctggccttgctgaccgcagccctcatcctttaccggaggcgccagagcatcgagcgcggggcctttgagggtgcccgctacagccgcagcagctccagccccaccgaggccactgagaagaacatcctggtgtcagacatggaaatgaatgagcaacaagaatagagccaggcgcgtgggcagggccagggcgggaggagctggggagctggggccctgggtcagtctggccccccaccagctgcctgtccagttggcctatggaagggtgcccttgggagtcgctgttgggagccggagctgggcagagcctgggctggtggggtgccaccctcccacaagggctgggctgagacccagctgagtgcagcgtggcgtttccctttctgggggggcctgaggtcttgtcacctggtcctgtgcccccacaggaaccagaggtaggatgggagggggaacgagagcctctttctccccagagcccccggcccaggcctgttgatccgcgccccaggacccccttctttgcagagcccgaggagcctcccctgtcccctcgggcagatctgttgtgtctctcttcccacctggcagcctcagctctgtgcccctcaccctgctccctctcgccccttctctcccaccccttccttctgagccgggccctggggattggggagccctcttgttcctgatgagggtcagctgagggggctgagcatccatcactcctgtgcctgctggggtggctgtggggcgtggcaggaggggcctaggtgggttgggcctgagaaccagggcacgggtgtggtgtctgctgggctggagataagactggggagagacaccccaacctcccagggtgggagctgggccgggctgggatgtcatctcctgccgggcgggggagggctctgcccctggaagagtcccctgtggggaccaaaataagttccctaacatctccagctcctggctctggtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaa

SEQ ID NO: 17067 - DNA, 3201 bp, Homo sapiens
atatgatgatccgggggcctctttgtatttggtgcctacttaccatgtactggggggcttgaggcaggaaggaccaggagcacctgggactcagaatttgagcttgtctttttgcccttgggcttcctgccctggagtcctcaggcttcttttctggagcagcaagtgtccagggacagctggggccttatctagaggcaccaggtccttgggtctttgactgccctgagctcagtagctccacccctcagcctacagccactaaaccccagaacctgggcccttccctgcccccattcctgcggccttcattgctgcatccggtggaggcccagctgggggccggtgctggagttacctctgctccatgccattgcagatggacagatggttccattataaacttcatctcctgggcaccaggcaaacctcggcctgtcggcaaggacaagaagtgcgtgtacatgacagccagccgaggctagactcagcgaggggtggacctgtctccatggtccagaagacttgaattcggagctggacacaggccctgagcctctgcccagactcctctcagggcatgaggctgagtgtgctgccagccatgccctgccctgctctgccctgggggtgactgccctcccctcccctttccgcagaggactggggggaccagaggtgcctgacagccttgccctacatctgcaagcgcagcaacgtcaccaaagaaacgcagcccccagacctgccaactacagccctggggggctgcccctctgactggatccagttcctcaacaagtgttttcaggtccagggccaggaaccccagagccgggtgaagtggtcagaggcacagttctcctgtgaacagcaagaggcccagctggtcaccatcacaaaccccttagagcaagcattcatcacagccagcctgcccaatgtgacctttgacctttggattggcctccatgcctcgcagagggacttccagtgggtggagcaggagcctttgatgtatgccaactgggcacctggggagccctctggccctagccctgctcccagtggcaacaaaccgaccagctgtgcagtggtcctgcacagcccctcagcccacttcactggccgctgggacgatcggagctgcacggaggagacccatggcttcatctgccagaagggcacggggctctcggcggtactcctgggtctcagaggagccgctgaactacgtgggctggcaggacggggagccgcagcagccggggggctgtacctacgtagatgtggacggggcctggcgcaccaccagctgtgacaccaagctgcagggggctgtgtgtggggttagcagtgggccccctcctccccgaagaataagctaccatggcagctgtccccagggactggcagactccgcgtggattcccttccgggagcactgctattctttccacatggagctgctgctgggccacaaggaggcgcgacagcgctgccagagagcgggtggggccgtcctgtctatcctggatgagatggagaatgtgtttgtctgggagcacctgcagagctatgagggccagagtcggggcgcctggctgggcatgaacttcaaccccaaaggaggcactctggtctggcaggacaacacagctgtgaactactccaactgggggcccccgggcttgggccccagcatgctgagccacaacagctgctactggattcagagcaacagcgggctatggcgccccggcgcttgcaccaacatcaccatgggtgtcgtctgcaagcttcctcgtgctgagcagagcagcttctccccatcagcgcttccagagaacccagcggccctggtggtggtgctgatggcggtgctgctgctcctggccttgctgaccgcagccctcatcctttaccggaggcgccagagcatcgagcgcggggcctttgagggtgcccgctacagccgcagcagctccagccccaccgaggccactgagaagaacatcctggtgtcagacatggaaatgaatgagcaacaagaatagagccaggcgcgtgggcagggccagggcgggaggagctggggagctggggccctgggtcagtctggccccccaccagctgcctgtccagttggcctatggaagggtgcccttgggagtcgctgttgggagccggagctgggcagagcctgggctggtggggtgccaccctcccacaagggctgggctgagacccagctgagtgcagcgtggcgtttccctttctgggggggcctgaggtcttgtcacctggtcctgtgcccccacaggaaccagaggtaggatgggagggggaacgagagcctctttctccccagagcccccggcccaggcctgttgatccgcgccccaggacccccttctttgcagagcccgaggagcctcccctgtcccctcgggcagatctgttgtgtctctcttcccacctggcagcctcagctctgtgcccctcaccctgctccctctcgccccttctctcccaccccttccttctgagccgggccctggggattggggagccctcttgttcctgatgagggtcagctgagggggctgagcatccatcactcctgtgcctgctggggtggctgtggggcgtggcaggaggggcctaggtgggttgggcctgagaaccagggcacgggtgtggtgtctgctgggctggagataagactggggagagacaccccaacctcccagggtgggagctgggccgggctgggatgtcatctcctgccgggcgggggagggctctgcccctggaagagtcccctgtggggaccaaaataagttccctaacatctccagctcctggctctggtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagag

SEQ ID NO: 17068 - DNA, 2756 bp, Homo sapiens
ccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaa

SEQ ID NO: 17069 - DNA, 720 bp, Homo sapiens
caatttgttgtcattgatttgtagtgtaaaagacaactgtacttatgggaagtctagaaacccttgagatttgtgacctgtagaggccaaagaggtttcagaagactacatcaagccatcaaacagtaaagaggcaaggatggctccacccaagctgtcatcattcttttttaagttctttcatttccctcttcccaactttgtagtttgttctgaaagactcacctatacattagactacaagttacatataaatgaattttctgctgcagatgctcttgttacagagatattaaaatgtactatgtgttgcatatgccagagaatcttgtactttctggataattaaaataccatcgatttattacacattcatacgctttatctctttcctctctctcctgatcctacctgccctccccaacacacactctctcccaaaggatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaa

SEQ ID NO: 17070 - DNA, 596 bp, Homo sapiens
agagtggggcacagcgaggcgctagggggaacgctggcctctgaaactagctctgggaccggggtctgcggccggcccctagctggccccgtctcccatccccagaagggtattcactggggattctgagctttggctactccagtttcccacgacactgtaaaagacaactgtacttatgggaagtctagaaacccttgagatttgtgacctgtagaggccaaagaggtttcagaagactacatcaagccatcaaacagtaaagaggatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactc

SEQ ID NO: 17071 - DNA, 3569 bp, Homo sapiens
ggtaaatatgtgttcattaactgagattaaccttccctgagttttctcacaccaaggtgaggaccatgtccctgtttccatcactccctctccttctcctgagtatggtggcagcgtcttactcagaaactgtgacctgtgaggatgcccaaaagacctgccctgcagtgattgcctgtagctctccaggcatcaacggcttcccaggcaaagatgggcgtgatggcaccaagggagaaaagggggaaccaggccaagggctcagaggcttacagggcccccctggaaagttggggcctccaggaaatccagggccttctgggtcaccaggaccaaagggccaaaaaggagaccctggaaaaagtccggatggtgatagtagcctggctgcctcagaaagaaaagctctgcaaacagaaatggcacgtatcaaaaagtggctcaccttctctctgggcaaacaagttgggaacaagttcttcctgaccaatggtgaaataatgacctttgaaaaagtgaaggccttgtgtgtcaagttccaggcctctgtggccacccccaggaatgctgcagagaatggagccattcagaatctcatcaaggaggaagccttcctgggcatcactgatgagaagacagaagggcagtttgtggatctgacaggaaatagactgacctacacaaactggaacgagggtgaacccaacaatgctggttctgatgaagattgtgtattgctactgaaaaatggccagtggaatgacgtcccctgctccacctcccatctggccgtctgtgagttccctatctgaagggtcatatcactcaggccctccttgtctttttactgcaacccacaggcccacagtatgcttgaaaagataaattatatcaatttcctcatatccagtattgttccttttgtgggcaatcactaaaaatgatcactaacagcaccaacaaagcaataatagtagtagtagtagttagcagcagcagtagtagtcatgctaattatataatatttttaatatatactatgaggccctatcttttgcatcctacattaattatctagtttaattaatctgtaatgctttcgatagtgttaacttgctgcagtatgaaaataagacggatttatttttccatttacaacaaacacctgtgctctgttgagccttcctttctgtttgggtagagggctcccctaatgacatcaccacagtttaataccacagctttttaccaagtttcaggtattaagaaaatctattttgtaactttctctatgaactctgttttctttctaatgagatattaaaccatgtaaagaacataaataacaaatctcaagcaaacagcttcacaaattctcacacacatacatacctatatactcactttctagattaagatatgggacatttttgactccctagaagccccgttataactcctcctagtactaactcctaggaaaatactattctgacctccatgactgcacagtaatttcgtctgtttataaacattgtatagttggaatcatattgtgtgtaatgttgtatgtcttgtttactcagaattaagtctgtgagattcattcatgtcatgtgtacaaaagtttcatccttttcattgccatgtagggttcccttatattaatattcctcagttcatccattctattgttaataggcacttaagtggcttccaatttttggccatgaggaagagaacccacgaacattcctggacttgtcttttggtggacatggtgcactaatttcactacctatccaggagtggaactggtagaggatgaggaaagcatgtattcagctttagtagatattaccagttttcctaagtgattgtatgaatttatgctcctaccggcaatgtgtggcagtcctagatgctctatgtgcttgtaaaaagtcaatgttttcagttctcttgattttcattattcctgtggatgtaaagtgatatttccccatggttttaatctgtatttccccaacatgtaataaggttgaacacttttttatatgcttattgggcacttgggtatcttcttttgtgaagtacccgttcacatttttgtattttgtttaaattagttagccaatatttttcttactgatttttaagttatttttacattctgaatatgtcctttttaatgtgtattacaaatattttgctagtttttgacttgctcctaatgttgaattttgatgaacaaaatttcctaattttgagaaagtcttatttattcatattttctttcaaaattagtgctttttgtgtcatgtttaagaaatttttgcccatcccaaaatcataagatatttttcatgattttgaaaccatgaagagatttttcatgattttgaaatcatgaagatatttttccatttttttctaatagttttattaataaacattctatctattcctggtagaatagatatccacttgagacagcactatgtaggaaagaccatttttcctccactgaactagggtggtgcatttttgtaagttaggtaactgtatgtgtgtgtgtctgtttctgggctgtctattctagtctatttgttgatgcttgtgtcaaacagtacactatcttaattattgtacatttatagttgtaactatagtccagctttgttcttcttaaagtcaagatttccatataaatattagaaacagcttctcaatttctacaaaatcctgatgaggtttctactgggaccacattgagtctatcaatcaacttatgcagaactggcaacttactactgaatctctaatcaatgttcatcatgtatcgcttcatgtaactagaatttctttaacttaattgctatgttttgacatttttagtttaaaaaccttgtatatcttgttttggtggttttagtgattttaataatatattttaaatattttttcttttctattgttgtacacagaaatacagttaagttttgtgtgtagtcttacgatgtttagtaaactcaataagtttatttcttaaatctagtaatttgtagattcctctggattttgtatatgcatagtcatgtaagctgaaaatatggcaatacttgcttcttcccaattgctttaccttttttcttaccttattgcactggttagcaaccccaatacagagaccaccagatcaggtatagactcctgaaagacaatataatgaagtgctccagtcaggcctatctaaactggattcacagctctgtcacttaattgctacatgatctagagccagttactttgtgtttcagccatgtatttgcagctgagagaaaataatcattcttatttcatgaaaattgtggggatgatgaaataagttaacacctttaaagtgtgtagtaaagtatcaggatactatattttaggtcttaatacacacagttatgccgctagatacatgctttttaatgagataatgtgatattatacataacacatatcgatttttaaaaattaaatcaaccttgctttgatggaataaactccatttagtcaca

SEQ ID NO: 17072 - DNA, 1605 bp, Homo sapiens
aattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtgtaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatacta

SEQ ID NO: 17073 - DNA, 1790 bp, Homo sapiens
agctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgctggattaaaaaaggaggatgaggcccgtcccgtgaggtctgcgtccatgagggttagaggtgggttaggggcatgggggcaccagcaaggggagggttgtatggagtgggagagccagggggcaggtagtgggtataggtgggcagcagttccccctggagcctagggtcactctgagggagggagcacggtgagggggcttccagtttgcagtgggaagagctgcagagagaaacaagaggttagagggcacttccctgggttggaggtgagtctggccagttctgggcagacagggtagagcgtgccacccacccagccctggctacccagcccgctgggcgcagcaggcatggaagccgaccccgggatggagagcccgcggccctgttggggcacgctcgggagcgggcttgcgtgctgcacggctgttttcctcttggggagtcaggccaggaaagggcagaatgagctcggcctctccttgccctgggggctgggagaggaagctgggtcacacacaggccagaagcaggggggaaacggggcatctaactaggacacagtcgcatccaggggtcagtcacctgaccctacagggcccaccaccttcagactgagatggaaacgccctctgggagaaccctgatccgccccaccctacacaggccccggaggtactgggcctgcgcccgccacaccttggccgcgagtggcctctgcttgggtgggctcccgtcctccggcatccgcccccaccaaggctccagaagaggggcgcatgggcctccgtcttcggcccgcttcccaggcactcacccatagctgccaggcaggtaggctgtcgagtagctggggggtctgtacccaaagcctctgctcggttgggtggtcgcgtaccccggcccccagagcgggccgccgctggccaggttgcctcttccctgtccgcagcgggaaggtccggcgcccgagctcttggccttgcgccgaggccggtacttgtagtcggggtagtcgcgcaggtgtcgggcgcggagccgcttggcctcctccacgaagggccgcttctcgtcctcgtccagcagcttccactgcgcgcccaggcgcttggagatctcggagttgtgcatcttggggttctgctgcgccatctggcggcgctgagcggagctccacaccatgaacgcgttcatcggccgcttcaccttctccaggggcagcgtcccggaccaccaccccaacccctttcctggtgcctgttgctcctcaaatcccagaactgcccctggggcaagaaaggccgaggagggagaccatttttgtttcctgagtcattccagcagaagtaagaccatctttgggacaagagacaatgaagagaagtcagatgtggaggaacagaaaacaagagccaggggccagggcaggtcagtcctagagaaacaaatggaccaaactggggacaaagaaggcacaggagccagacagccatttggatttttttattctctttttaaatactgtacagtgaaaaataaatacgccttctcatccacc

SEQ ID NO: 17074 - DNA, 900 bp, Homo sapiens
atggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcccctgctccggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttga

SEQ ID NO: 17075 - DNA, 1007 bp, Homo sapiens
gcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaacaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagcc

SEQ ID NO: 17076 - DNA, 888 bp, Homo sapiens
gctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggggtgagcatcccattctctcagctctgaggaaggattctggtgtccagagttggctgacctggctggcggtctccactgatagagccatcagtccgattaccacggttacggcggcggcggctgcgattacgacgttgaggtcttgattcatcttctgtagggtaggaaaaaaccagagtcacacatccaacctcccaccctcgattcctacccatctctaactttccagaccccaggcacaccctcacccaggccattctctgtcatgttgggcccatctgattccaggcctccatccatgacggtcctgtcttcatcagtgcggcggcggcgggagcggcggc

SEQ ID NO: 17077 - DNA, 2961 bp, Homo sapiens
aagaggagcgagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctagccctggtgacagtgcccagcatgggctatgctcctgttcctccccccacctcactgcagcccctgctgccccagcagcctgtgttcgtagtgcaagagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 17078 - DNA, 3300 bp, Homo sapiens
gagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctaggcctcacccccagccctggtgacagtgcccagcatgggctatgctcctgttcctccccccacctcactgcagcccctgctgccccagcagcctgtgttcgtagtgcaagagcccctacagactcagcctcaaggcctcctcccacaaagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 17079 - DNA, 3177 bp, Homo sapiens
agcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctagccctggtgacagtgcccagcatgggctatgctcctgttcctccccccacctcactgcagcccctgctgccccagcagcctgtgttcgtagtgcaagagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaaggcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 17080 - DNA, 1909 bp, Homo sapiens
gtaccgtgctgctctactcgctgccattcgcccgcaggtcggcgcgctcgcccacctgagccgcgccggggctgcgggaccgtgggacagcgcgctcagcccagcctaggaaagaggcagcagtctcagcgcggagatggggagcgggcgaagttgacgagtctcccgcccacgctgcgcccctcctgcccagaggggctgcagccagcggtctgtcgcgcgtgcctgtgtgcccgaggagccgccccggggagaagacccggcgcggagttgttcccccagggaggatccgcagcccagccgagggggtcgggcggcctggctacgcaggacccagccccgcagccgcggactcccagcggcggcgaagtttggctgctgagcggcgcggcgccggaccactggacagcgggagcgatgcccgtggggggcctgttgccgctcttcagcagccccgcgggcggcgtcctgggcggggggctcggcggcggcggtggcaggaaggggtcgggccccgccgccctccgcctgacggagaagttcgtgctgctgctggtattcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctgcagaagctgcccgaggagatccaaagagacatcctactggagaagaagaaggtggcccaggaccagctgcgtgacaaggcgccgttcagaggcctgcccccggtggacttcgtgcccccaatcggggtggagagccgggagcccgccgacgccgccatccgcgagaaaagggcaaagatcaaagaggaaattgaagccaggaaggggcaagcaaattgcccagggtcgagcagctcctgcgaggttgaaatccagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaagaaaatttagattttaatgtgaatgctgaaatttctgtctttgaagtaaatatacgctttgttggtggactactctcagcctactatctgtctggagaagagatttttcgaaagaaagcagtggaacttggggtaaaattgctacctgcatttcatactccctctggaataccttgggcattgctgaatatgaaaaggtggatgtgcaatatcccaagggctatggaggctaccatatgaggtgggatatcattggcccacactggaaagagaaatagctctgataaagtcatcatctcctcttaccctgatattgccttatgtcgcagctttgtttttaatatttctccagaccacagaaatttgtagttttgctaaataggcttattgacgttagtcagtgatggagtgattggaataaaacagtgatatgtcatgacaactagttaatgaccaattaccatgtgcatttgccatatgttagtaaactttgaaagtagctattcatcctatttggatgattggaaattcttttttataagccaactatgaaaataaaacctgactcacattcccagagcctaataaatttagggcattttgtaaaataaatgaatatatcattttc

SEQ ID NO: 17081 - DNA, 5014 bp, Homo sapiens
agtgctcgcggggccgcggcggagtgtaccgtgctgctctactcgctgccattcgcccgcaggtcggcgcgctcgcccacctgagccgcgccggggctgcgggaccgtgggacagcgcgctcagcccagcctaggaaagaggcagcagtctcagcgcggagatggggagcgggcgaagttgacgagtctcccgcccacgctgcgcccctcctgcccagaggggctgcagccagcggtctgtcgcgcgtgcctgtgtgcccgaggagccgccccggggagaagacccggcgcggagttgttcccccagggaggatccgcagcccagccgagggggtcgggcggcctggctacgcaggacccagccccgcagccgcggactcccagcggcggcgaagtttggctgctgagcggcgcggcgccggaccactggacagcgggagcgatgcccgtggggggcctgttgccgctcttcagcagccccgcgggcggcgtcctgggcggggggctcggcggcggcggtggcaggaaggggtcgggccccgccgccctccgcctgacggagaagttcgtgctgctgctggtattcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctgcagaagctgcccgaggagatccaaagagacatcctactggagaagaagaaggtggcccaggaccagctgcgtgacaaggcgccgttcagaggcctgcccccggtggacttcgtgcccccaatcggggtggagagccgggagcccgccgacgccgccatccgcgagaaaagggcaaagatcaaagagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaagaaaatttagattttaatgtgaatgctgaaatttctgtctttgaagtaaatatacgctttgttggtggactactctcagcctactatctgtctggagaagagatttttcgaaagaaagcagtggaacttggggtaaaattgctacctgcatttcatactccctctggaataccttgggcattgctgaatatgaaaagtggtattggaaggaactggccctgggcctctggaggcagcagtattctggcagaatttggaaccctgcatttggagtttatgcacttgagccacttatcaggaaaccccatctttgctgaaaaggtaatgaatattcgaacagtactgaacaaactggaaaaaccacaaggcctttatcctaactatctgaatcccagtagtggacagtggggtcaacatcatgtatcagttggaggacttggagacagcttctatgagtatttgctgaaggcctggttaatgtctgacaagacagatctggaagctaagaagatgtattttgatgctgttcaggctatcgagactcatttgatccgcaagtctagcagcggactaacttatatcgcagagtggaaagggggcctcctggagcacaagatgggccacctgacctgcttcgcggggggcatgttcgcactcggggctgatgcagctcccgaaggcatggcccaacactaccttgaactcggggctgaaattgcccgtacttgtcatgaatcatataatcgaacatttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccccactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtcaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatata

SEQ ID NO: 17082 - DNA, 2497 bp, Homo sapiens
gggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacagtcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagagatgatgaaacatgcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcaggaacttctcaagggatgaggagacagaacccctacttccaagtgctctatttgtattacccagatgactga

SEQ ID NO: 17083 - DNA, 8576 bp, Homo sapiens
agacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacagtcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagagatgatgaaacatgcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaaatgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctagtgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactcaacttacaactttatttatgtggcttggcaaaaatcactataaggcagctctaaatttgccttgataagctaaataaattacttttataacttactaaagcagaacaaacagtgaaactttctaaaatattctatctggaatagggacaggggatcttttatttataatctcatcagatgagtgagttgttcacagatattttatgtttttttaattttctccaagaatatttatagaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacaaaaagaacttaaattttatcaggaactgtaagataaatatctagtgcttataaattttctgtccttaaatttatgtgacagtgcaagatacttttgctcttttcatttaatataggcatcttccattgacattaataaaacttagaaacagtataattagtataacatttactctgaatttgaagatttcctgaaacaaagtttgtacaagaagcccaccttggaattctgaaggcttattttcttgtttgataagcttttcttttaaacttaggttttaagttggggaaagacttaattaactaatatagtattttctaaggttgatcatcttataccacgaatcgttaattttgacagttctactgatccgtaaatgataaccactgcaaattttttcagtataaaatttttcactgcaaaaaaatttcagtagaaaataaggatgcagggccagttacaatagtccttaagagagttaaattatagcacatgttttgacattgtaatatcttttactacttgaacatttaaatttctaaatgagaaaggtatatatattactgtaactgtagaagggaaaagggaaagtatttggttctaaaaaatgttagccttcctcgtaaaagtagcacaagcccacttatgaatcactgagaaaaagtgaaaaacttgagttggcaaagatgcagagcagcagtgcagatggcaatgaactctctgaattctcttttaccttatttagaagaatgcagagtaaagggaccttcttggttctgcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatgacttgccagtgtcatgttttatttttgttatagatttttaaattatttccttcaagatcaattcttatcccatataatgcttagcttccaagaatattctttactttcttctgtcttttacagctctttgcattttgtagaccttaatactcaggttaaatattcattgcatttataagatcttctgcaaaaagcccagaaatggtccttttcaggtgcctcttcaaagagctgacaccttaccttgtgcctttggcacaaatgtgcagaatagatacatcagttggtgcataatcgaaaaaaataggaattttgaacactgttcttccttctacatttatttctcttcattttagaatcacactttttatgttaaaccagattattattattattattattcaaccagtattaagttgttaaaaccaagggaatggggccctaaccaaaaagaagtctcaactcagaaaaataagtccccagtcaggtggttcttactttcttgtgggttgcacattttgtatctctctaacatcagcgtattcctgactttaagcaggtgtttatatgtaaaataaaacctgggtatcgaagggaaatgcattctttttatggagtattgaccctgatcctctatgatgtcatatagagcaactcagggctatacttgctagattttaaccaagcagtttgaaatattaatcatcatcctctcatcttctccactctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtatgagagtagctcacaacattttaaatgtttccaatatgaatcgtgttacaaaattcttaattttatatttcatataaattaaagaggaaaaagaaaaggtttataatatattttaaaacaatgtgttactgtataatacaactataattgtagttaataactaaaacctcttgaaaatgtcaaagaaatacttgatttctgatgcaactttgactaaaatatttactttagaaataaaaacgttcttattttgctatatcactttaattgcataattaaaaagcagtgttttatagaaatgctggttattttatattcaaaaagattttgtcacataattcatgggtaaaacttgcagttgtaaattgtgtctgctctggtatgggccctattaatagtcccatgctgttaaatataaagaaaaatatactaaaatattcaaagttccaaataacagttcctagtaatagtattttgagttatttttctttaggtttccttatactcaaattggctaggtcctatcttttcctctctctctctctctctctctctctctctctctctctctatatatatatatatatatatatatatatgagagatatatgagatatatgagagatcaagatctatatatgtatataaatacaattatacacagataatttttaatactctttgttaacaaacacagttgaaaactggtttcggctgcacaaataagcagaatatttgagtaactatatatgatatggagatattttaatccatttatcctggctcaagaacactgataaagatgattttctgttactttagctcattcagatcaggatggacatgctctttttgatctataactgttcagccagcttccagataatattttaggctatgagagctatacagtctctcttattactcatttctgctgttgaagtatcgaaaacagatagagatactatgtaaagaatgggcgtagctatgttccaggaaaactttatttacaaaagcagatggagggctggatttggtccatgggtcatagttagtgaccctgatcccaagtttattttgtgttagaccctctaacctttgatctgcgtcttttctgttttgatttacataattcatttttaaatcaaaaagatgtgcgtatatatggttgtgtgtatctgtataacctaaagctataatattttgttgtcttgaaagcagatacactcttcctggagtctgttcaggtttcaggacgattgactataatgaaagagacagaatagggtaagggaagatgggtatgctatcagccattttctttgccttgtcatttaatgccataatttcagattctctatgtaaaaagaaggtctgtgtattgtcaaaataatatactctccaagttctcctgctcattgacccttgaaccaggattctggattgctagagctgcagaaattcacccacttgggtactcttagagctctacagcaagaatatgatagaatgtctgatctttgtgctgcagaaagcaaacttttgaagaattctaagcaacagaaaatgggttatgtgactcatctgctatttggcagccactattccttttttagactgcagaacggtactgcccctgttacctctagaatagcctgagtctgaggagtgcagagaaaagatatatccaaaaggagaatccctttctcttgcataactctcaatcctttacaagtaagtagcattatttcagaatgtctatatgcatcattttcaactaaagcatacctcatccttaaacttccactatttaacagctaatccatttcaaacttggtttgagcctagcaattgcagaactcataaaattgcttgtgaaattacacaccatattactagcatatacattgcagtgctccaatcatgctaacagataatagatttttctttaagaattttatcaaatatttcactatttggggaaattttagaggaggggaagcctgtattcaggatgatagagggagcagagacttactgtctctcttccacattataaatgaactgcctttccaggtccaacatgctgtcaggttgcttcagctcggtgtgaatgtaagtgtggggatcaaacacacacacctatacacatacatattaatatgcagaggattttaaataattgcaaatgtcttgtggctgttttatttctacaaaattctgtaagatgtataccagaaaacataataaagataagctcagttcttcattgggaaaaaatatttttaaagaaaatttagaagtttttgctgaattaaagtatcttcaattttaattactggatttggaagttgaaatgccatccttcaatatcactggtctcaaattcattgatagaattttttcttaaactaataagtggggtaagtataatctcctaaattggtacccactggctgctcctaaactggtttccagtcatgtcctccagtatgtgatttttataaattaaaggtaatattgtatattaaagttcaaataaagatgttctttaagtgaaaa

SEQ ID NO: 17084 - DNA, 2571 bp, Homo sapiens
agacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacagtcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagagatgatgaaacatgcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaagttagcctcctaccatgagagaactgtttttccagctggatga

SEQ ID NO: 17085 - DNA, 678 bp, Homo sapiens
tattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcagagtcctgaagtctggaggctagacttcctgaaagcaagtcaagaatatagagcaccttgcaggagttcaagat

SEQ ID NO: 17086 - DNA, 487 bp, Homo sapiens
gaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatga

SEQ ID NO: 17087 - DNA, 2083 bp, Homo sapiens
acattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaagttagcctcctaccatgagagaactgtttttccagctggatgaaaagagtagcatcaagtcccctattctgctgttttctgctcacttactcctggagacaagctaagtcaaatcaatatgtacttataagtacctgctttctcagagttgtatttgagaattaaagtatatgaaatgtatactctacccataaatagcttggagtctggtttagaaatctcttacctttaggcatggacaaatttaataaaagtacaaagtatatatgcagttggccctccatgtcaatgggttcatggattcaaccaaacatggattgaagatatagttttttaaaaattacatctgttttgagcatgtatatacctttttcttgtcattattccctaggcaatataacaactatttacatagatttaaagtatgtgggagcatatgcattggttatatgaatatactataccattttatatcaaggatttgagcattcaaggatttttgtatctgcgagaggtcctggaaccaatcccccatagatactgagggacaactgtattcagtgctaaatagaaaataaatgttttagaaattcagagaagggaattttggtgcaggccagagtagtcatgaagaaagactaaaatgatgctgaattagtaagatgttaataggtggggtaaaacagaaagtagctttgtgaaaagaaggattcagcctgaaaaaatacctttaaaaaaacactaaagaaactagaccgactaaagtacattcactaggagaagtagtaggaaataagagctctagaatcaaaatcagggaagcagcatggatgacccttgaggacattatgctaagtgaaataagtcagccataaaaagacaaatatggggtgattccacttctatgaggtctctaaagtagtcacatttatggaaacaaagtagaatgttggttaccagggacctggggaggggaatggaaatgagttttagttttgcaaagaacagtgtgaatatacttaatactactgaactatacgctgaaaaatggtgaagatggtaaactttatgtcatgtgtttattaccacaat

SEQ ID NO: 17088 - DNA, 2765 bp, Homo sapiens
actggccgcatagagacgcagcgcacgcgcagtcgcgtatccgtgtgatgggcgggctgttgacggcgctgcgatggctgcctgcgagggcaggagaagcggagctctcggttcctctcagtcggacttcctgacgccgccagtgggcggggccccttgggccgtcgccaccactgtagtcatgtacccaccgccgccgccgccgcctcatcgggacttcatctcggtgacgctgagctttggcgagaactatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggatgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaa

SEQ ID NO: 17089 - DNA, 2336 bp, Homo sapiens
attctttttgaagaccagccatggccagttccggttttacttctgactgtgcagtgttgaataagacagacctgtttcctctcaagaggccacagctggtaggagaggctgaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggatgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctct

SEQ ID NO: 17090 - DNA, 2296 bp, Homo sapiens
cccttgggccgtcgccaccactgtagtcatgtacccaccgccgccgccgccgcctcatcgggacttcatctcggtgacgctgagctttggcgagaactatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtgagcacctgtcctcgccccgcgtggtcacggccaccgggccacaggcacggctgggctgtggggctcaggctggctccgctcttggtggtggctgtgacctggatccgggaggggcgggcttgccgcagcctcggggtggccacactgcagcttgggggccctggcatccccatccccactgagcttcatggttgtgggacccagagtacttggaggggctgggcacccctcattttcatttctcagggcctgtctagggagggtctctgctgtgggcccagcatccccccagtttaggaggcacacgcacccatgactggggcaccatccccactgtggaccaggccctgttttaggtcacgccctccacgccagagtgtcacttcctggctctgctgtgatcttggcctgaggcccccgctgcctccgctcccaccgtctgccctgtgccctgtgccctgtgcggcaactgtgagg

SEQ ID NO: 17091 - DNA, 4667 bp, Homo sapiens
ggcggggccagccgcccgctcggctcaggcgctgcgggcgcctattgacccagcggctgctgcgccgccgctgtctcctcctgctcgtggcgggcggtgctggagcgccaagtggcgctggagaaccggcgcttcctttcgccgcttccgccgccatctccgcgtttgtggggcgggaaagagggagggggctagcggctgcagctggagcgggcttctctccggggacggtcctttcctccctgctctccttttccttctttccgcgttgccgccgcccgccccctgcgcctccccgcggagcctgggtccgggagggggaaggtaggggcggcggggggcgggagagtctggcgagcggacgctagctctgaggaaactcatcaatccgtgagccccggagtccggggtgcacatcggcccagccgcagcgtcggcggcggcggcggcagcagcacgaaggggctcagtcggggtaggcgggggcggtgccggtgccgcgggggcgggcccgaccgtcccgcccagaagttgtagggcttggctcctcgcgatcttgttcctttcccctccgcttctctgacctagctgcgcggccccggcccgggagctgccgaacccgcgcctcccctgggtgaggaggacacgcctgccctcgtcgagaaaacttttcctgccgactcagttggggcggcggtggcaggaagtgcgggcagcgacctctcctccgcctgccccgcgcgccctgccggaggtcggcgctgagcttgcgatcaagtttgtgggggccccccttcccagttgccggcgagtctcgcctcgagaggggcgcccgaccccggggagggcggcaggccagggcgaaggccaagggcgtgtggtggcgccggagactaggtgcggagcaaggcggggactcgcacccgcatccgagagcgcggaggtcgcgcagcccgggagaagggagcctccggcggctgcttcctagagtccacagtgcgctgtctcctttggctgaggagagtgtcctggccccgagtctatcgaggaaaatgaagttaagccgccagttcaccgtgttcggcagtgcgatcttctgtgtggtgattttctcgctctacctgatgctggaccggggtcacttagactaccccaggaacccgcgccgcgagggctccttccctcagggccagctctcaatgttgcaagaaaaaatagaccatttggagcgtttgctagctgagaataatgagatcatctcaaatattagagactcagtcatcaatttgagtgagtctgtggaggatggtccgaaaagttcacaaagcaatttcagccaaggtgctggctcacatcttctgccctcacaattatccctctcagttgacactgcagactgtctgtttgcttcacaaagtggaagtcacaattcagatgtgcagatgttggatgtttacagtctaatttcttttgacaatccagatggtggagtttggaagcaaggatttgacattacttatgaatctaatgaatgggacactgaaccccttcaagtctttgtggtgcctcattcccataacgacccaggttggttgaagactttcaatgactactttagagacaagactcagtatatttttaataacatggtcctaaagctgaaagaagactcacggaggaagtttatttggtctgagatctcttacctttcaaagtggtgggatattatagatattcagaagaaggatgctgttaaaagtttaatagaaaatggtcagcttgaaattgtgacaggtggctgggttatgcctgatgaagctactccacattattttgccttaattgatcaactaattgaaggacatcagtggctggaaaataatataggagtgaaacctcggtccggctgggctattgatccctttggacactcaccaacaatggcttatcttctaaaccgtgctggactttctcacatgcttatccagagagttcattatgcagttaaaaaacactttgcactgcataaaacattggagtttttttggagacagaattgggatctgggatctgtcacagatattttatgccacatgatgcccttctacagctatgacatccctcacacttgtggacctgatcctaaaatatgctgccagtttgattttaaacgtcttcctggaggcagatttggttgtccctggggagtccccccagaaacaatacatcctggaaatgtccaaagcagggctcggatgctactagatcagtaccgaaagaagtcaaagctttttcgtaccaaagttctcctggctccactaggagatgatttccgctactgtgaatacacggaatgggatttacagtttaagaattatcagcagctttttgattatatgaattctcagtccaagtttaaagttaagatacagtttggaactttatcagatttttttgatgcgctggataaagcagatgaaactcagagagacaagggccaatcgatgttccctgttttaagtggagattttttcacttatgccgatcgagatgatcattactggagtggctattttacatccagacccttttacaaacgaatggacagaatcatggaatctcatttaagggctgctgaaattctttactatttcgccctgagacaagctcacaaatacaagataaataaatttctctcatcatcactttacacggcactgacagaagccagaaggaatttgggactgtttcaacatcatgatgctatcacaggaactgcaaaagactgggtggttgtggattatggtaccagactttttcattcgttaatggttttggagaagataattggaaattctgcatttcttcttattttgaaggacaaactcacatacgactcttactctcctgataccttcctggagatggatttgaaacaaaaatcacaagattctctgccacaaaaaaatataataaggctgagtgcggagccaaggtaccttgtggtctataatcctttagaacaagaccgaatctcgttggtctcagtctatgtgagttccccgacagtgcaagtgttctctgcttcaggaaaacctgtggaagttcaagtcagcgcagtttgggatacagcaaatactatttcagaaacagcctatgagatctcttttcgagcacatataccgccattgggactgaaagtgtataagattttggaatcagcaagttcaaattcacatttagctgattatgtcttgtataagaataaagtagaagatagcggaattttcaccataaagaatatgataaatactgaagaaggtataacactagagaactcctttgttttacttcggtttgatcaaactggacttatgaagcaaatgatgactaaagaagatggtaaacaccatgaagtaaatgtgcaattttcatggtatggaaccacaattaaaagagacaaaagtggtgcctacctcttcttacctgatggtaatgccaagccttatgtttacacaacaccgccctttgtcagagtgacacatggaaggatttattcggaagtgacttgcttttttgaccatgttactcatagagtccgactataccacatacagggaatagaaggacagtctgtggaagtttccaatattgtggacatccgaaaagtatataaccgtgagattgcaatgaaaatttcttctgatataaaaagccaaaatagattttatactgacctaaatgggtaccagattcaacctagaatgacactgagcaaattgcctcttcaagcaaatgtctatcccatgaccacaatggcctatatccaggatgccaaacatcgtttgacactgctctctgctcagtcattaggggtttcgagtttgaatagtggtcagattgaagttatcatggatcgaagactcatgcaagatgataatcgtggccttgagcaaggtatccaggataacaagattacagctaatctatttcgaatactactagaaaaaagaagtgctgttaatacggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtgggcaatgggcactccaatgaggcagccttgatcctccacagaaaagggtttgattgtcggttctctagcaaaggcacagggctgttttgttctactactcagggaaagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaa

SEQ ID NO: 17092 - DNA, 6268 bp, Homo sapiens
gtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttggggggccggggtcagaagccagagctgcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaacctaagaatcaactgaagacctgttaagagtattctgtaagtcaacccaatgatacacatcatgttcctgtccacatactggttttccccaaatcagctgataaattcagtgtaattccaatgagattgaaactttggaattgacagttctaaagtgcatttgggagagtgaatgtgtgagaacactaagaccactctgaacgatgataatgagttggggggtggactgctcgggggtgatcctgccagattcccagaggattctcacgccaccattacctcactcagtgtgacctggagggggtcagacagacgggagagtccagaaacagacccagggctacaggaatttagtatatggtaagagggatgttttaagtggggaaaaaggtggattatttaataaacagcacttttagacaactagctatcaaagctagatctcagctgggtgcgatggctcacgcctgtaatcccggcactttgggaggccaaggtgggtggatcacttgaggtcaggagttcgagaccagcctggccaagatggcgaaaccctgtgtctactaaaaatacaaaaactagccaggaatggtggcgcgcgcctgtaatcccagttacttaggaggctgaggcaggagaatcacatcaacctgggaggcggaggttgcagtgagcttagatcatgccaccatgccactgcactccagcctgggtgacacagccaaaaaaaaaaccactaagttagatctctacctcacagtgtccatacaaattagttccagagggaagatataccacaaaattactcaaaaatttttatacctctggtgtgggacggtcttttctaaactttaacatgagacttaaaagatataataagggaaaagataagcagatttcgcaaccaaaaaatatcgaaagtctctgtgtgatggaaaacatcaaggttaaaacacaaatgacagatatggaagaaaatatttgcagcacataaaaaaatcaacgagtacaattactttaggagaaaagcttgcttcagggtccttagagaaagtcactggggcctgccaagctgccacctaaagacaagagtgagagggctgagttcttccaggtcatcagagttgttgctgcccgtattaggccacacagtggaaccccatttatatcatagcagaagaaataggattatcaatgtgaactgcttagcatggtgcctggtatatacgagagctccacaaatgtgagctataatcctactagtaaaggatgctaagcagttccactgtggcaggtgtcatttgctagtagaatttgtaatcaaacaataggaggggaatctgtgaacgcctagaaaatgagcagaataaaggatattatctttggaagtctt

SEQ ID NO: 17093 - DNA, 1443 bp, Homo sapiens
gtttcctctccgtgtcattgactctggcaccagcgacttcgccctcagcaaccgctacatgcaggtctggttctcaggccttactgggctcctcaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacggggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctg

SEQ ID NO: 17094 - DNA, 2461 bp, Homo sapiens
tcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctca

SEQ ID NO: 17095 - DNA, 1049 bp, Homo sapiens
attgcagtatggattacactgaaaaactgtaaacaacctagatgcccagtaaaagggaaacagccaagaaaagtctgtgtcttgttcactcgctggcaggaaacatagagcaggcacggaaaggaaagggactcgaggaatgcgctgtaccgacaggaggcagcacccctttgcccgaggggcgcaacgacagagacctaaggctacctgggccggagccgggtgaggccgcggagaacgcaccccgctacgcgtctgccgagacggaggcgggcgtttcgaccactgcccgatcatgcgcttactcaactccacccacattggcctagacccagtctctaagggctgaaaatattgcccggaagctcccgagcagaatcagatcgcgctaagtagggcacaacgcagaggcgacaaagctcctcggccccagggcccgcggagcagactccggagcgcggtcccgcccacgctcggctccgcagttagcgtcctccttcctcctgagcaggcaagcggagcccgagggcggtggcggcggggggcacgggtcccctgaagttgcctcgcagctgagcactgggccccgtctctcccttcccagggggccttcggcgtcactgcaggcttcctaggggtcccctaagtgctctgcaaaccgcggctggaagtttcccactgcagtgaacagtagagaaacagggagaacacacagggcttgctttatgctagaaacacaagcatctttcttctttattagaaagaaactcattctgtgtttctgagaaaggatcgtgccaggcactgtttctggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaagga

SEQ ID NO: 17096 - DNA, 624 bp, Homo sapiens
aaacagccaagaaaagtctgtgtcttgttcactcgctggcaggaaacatagagcaggcacggaaaggaaagggactcgaggaatgcgctgtaccgacaggaggcagcacccctttgcccgaggggcgcaacgacagagacctaaggctacctgggccggagccgggtgaggccgcggagaacgcaccccgctacgcgtctgccgagacggaggcgggcgtttcgaccactgcccgatcatgcgcttactcaactccacccacattggcctagacccagtctctaagggctgaaaatattgcccggaagctcccgagcagaatcagatcgcgctaagtagggcacaacgcagaggcgacaaagctcctcggccccagggcccgcggagcagactccggagcgcggtcccgcccacgctcggctccgcagttagcgtcctccttcctcctgagcaggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgca

SEQ ID NO: 17097 - DNA, 5478 bp, Homo sapiens
gcgcgcgggagggctccggctgccccgacagaggccgggctcgggcggcgggagtgcgagcgccactgcggcgtcagaggggccaggaagggacaggaggctgcctgaggcccgtacctggcgcctgtctctgcggtccccggggccgacgaagtcggagcgggtggggagggagccgggcgggcggccagagacctggcggcaggtgcctgccctctgtgatccaactctctccccagctccacccacattggcctagacccagtctctaagggctgaaaatattgcccggaagctcccgagcagaatcagatcgcgctaagtagggcacaacgcagaggcgacaaagctcctcggccccagggcccgcggagcagactccggagcgcggtcccgcccacgctcggctccgcagttagcgtcctccttcctcctgagcaggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttggggggccggggtcagaagccagagctgcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaacctaagaatcaactgaagacctgttaagagtattctgtaagtcaacccaatgatacacatcatgttcctgtccacatactggttttccccaaatcagctgataaattcagtgtaattccaatgagattgaaactttggaattgacagttctaaagtgcattt

SEQ ID NO: 17098 - DNA, 537 bp, Homo sapiens
agtttgacccgaaagggcactgagaaaggctttcctatcagtctctttgggttctggctaaacttttaaatcaaacaaaatagagactagcttattcacctgaaactagaagcacatggccgaggagcctgaacaggcacctcctatctaggcagggaagctgtgtaatcaggagcttgtgtggtgcgctccagtcggagctgggactcttatcctgggcccgtttttcatagcaccagccaaaggagagcgtcctctccaccctagcggcagagctgctaccaggaccaggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctg

SEQ ID NO: 17099 - DNA, 529 bp, Homo sapiens
gcagcacccctttgcccgaggggcgcaacgacagagacctaaggctacctgggccggagccgggtgaggccgcggagaacgcaccccgctacgcgtctgccgagacggaggcgggcgtttcgaccactgcccgatcatgcgcttactcaagtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttgg

SEQ ID NO: 17100 - DNA, 3254 bp, Homo sapiens
ggagcgagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctagccctggtgacagtgcccagcatgggctatgctcctgttcctccccccacctcactgcagcccctgctgccccagcagcctgtgttcgtagtgcaagagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 17101 - DNA, 1111 bp, Homo sapiens
aaagaggagcgagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctg

SEQ ID NO: 17102 - DNA, 2904 bp, Homo sapiens
aaagcctcggctacttccgagggggtgagtggcttcaccgccggtcccttgcagcgctgcctttcgatctctccacatctcggtggcgcgggatctcaagatgcgcctccacctgctcctgctgctcgcgctgtgcggtgcaggcaccaccgccgcggagctcagttacagcttgcgtggcaactggagcatctgcaatgggaacggctcgctggagctgcccggggcggtccctggctgcgtgcacagcgccttgttccagcagggcctgatccaggattcttactacagatttaatgaccttaactacagatgggtctctttggataactggacctatagcaaagaatttaaaatcccctttgaaattagcaaatggcaaaaagtaaatttgattcttgagggagtggatacggtttcaaaaatcctgttcaatgaagtcactattggggaaacagacaatatgttcaatagatatagctttgatattaccaacgtggtcagggacgtgaactccattgagctgcgtttccagtcagcggtgttgtatgcagcacagcagagcaaagctcacactcgctaccaggttcccccagactgccctccacttgtgcagaagggtgaatgccatgtcaactttgttcggaaggagcaatgttcctttagttgggactgggggccttcctttcctacccagggaatctggaaagatgttagaattgaagcctataatatttgtcacctgaactacttcacattttccccaatatatgataagagtgcccaggagtggaatctggaaatagagtctacatttgatgttgtcagctcaaagccagttggtggtcaagtgatcgtagccatccctaagttgcaaacacaacagacatacagcattgaacttcaacctgggaaaaggattgttgagctatttgtgaacattagcaagaatattactgtagaaacttggtggcctcatggacatggaaaccagactgggtacaacatgactgttctttttgaactggatggaggcttaaatattgaaaaatcagctaaggtttattttaggacagtggaacttatagaagagcctataaaagggtctcctggtttgagtttctatttcaaaattaatggatttcccatatttctaaaaggctcaaactggatcccagcagattcattccaggaccgagtaacctctgagttgttacggctccttttacagtctgttgtggatgctaatatgaatactcttcgggtttggggaggaggaatttatgagcaggatgaattctatgaactctgtgatgaactaggaataatggtatggcaggattttatgtttgcctgtgccctttatccaactgatcagggcttcctggattcagtgacagcagaagttgcctaccagatcaagagactgaaatctcatccttctatcatcatatggagtggcaataatgaaaatgaggaggcgctgatgatgaattggtatcatatcagtttcactgaccggccaatctacatcaaggactatgtgacactctatgtgaaaaacatcagagagctcgtactggcaggagacaagagtcgtccttttattacgtccagtcctacaaatggggctgaaactgttgcagaagcctgggtctctcaaaaccctaatagcaattattttggtgatgtacatttttatgactatatcagtgattgctggaactggaaagttttcccaaaagctcgatttgcatctgaatatggatatcagtcctggccgtccttcagtacattagaaaaggtctcgtctacagaggactggtctttcaatagcaagttttcacttcatcgacaacatcacgaaggtggtaacaaacaaatgctttatcaggctggacttcatttcaaactcccccaaagcacagatccattacgcacatttaaagataccatctaccttactcaggtgatgcaggcccagtgtgtcaaaacagaaactgaattctaccgccgtagtcgcagcgagatagtggatcagcaagggcacacgatgggggcactttattggcagttgaatgacatctggcaagctccttcctgggcttctcttgagtacggaggaaagtggaaaatgcttcattactttgctcagaatttctttgctccactgttgccagtaggctttgagaatgaaaacacgttctatatctatggtgtgtcagatcttcactcggattattcgatgacactcagtgtgagagtccatacatggagctccctggagcccgtgtgctctcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcttgtcctcaccgaaggaggccgtggggctctgcaaggcgcagatcactgccatcatctctcagcaaggtgacatatttgtttttgacctggagacctcagctgtcgctccctttgtttggttggatgtaggaagcatcccagggagatttagtgacaatggtttcctcatgactgagaagacacgaactatattattttacccttgggagcccaccagcaagaatgagttggagcaatcttttcatgtgacctccttaacagatatttactgaaggaatctaggttgtattttcagtggacaatgggaataaagcatttctaaagcaccgactggagaggaaggcaacagagacaaggagagaagccgagagacatgtctgcgtgctgccacgcatttgagcgattgctctgtgaagagttgtacactgaacacttt

SEQ ID NO: 17103 - DNA, 4575 bp, Homo sapiens
gtctgggctcggggcgcggcggcagtcagctctatgttcgcggtcttaacctctcctctggccgagtccttgcaagaagtgaattacccgaccctgcaaaacacttactattttggagtttaaagtatgtcatcatggcaaagtttcggagaaggacttgcatcattttggcactttttattctatttattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaaatcactatgaaaccttccaaagcctctgaacttaacttggatgaactaccacctctgaacaattatctacatgtattttattacagttggtatggaaatccacaatttgatggtaaatatatacattggaatcatccagtgttagagcattgggaccctagaatagccaagaattatccacaagggagacacaaccctccagatgacattggctccagcttttatcctgaattgggaagttacagttctcgggatccttctgtcatagaaactcacatgagacaaatgcgctcagcttcaattggtgtactagccctctcttggtacccacctgatgtaaatgatgaaaatggagaacctactgataacttggtacccactattttggataaagctcataaatataacctaaaggttacttttcacatagaaccatatagcaatcgagatgatcaaaacatgtacaaaaatgtcaagtatattatagacaaatatggaaatcatccggccttttacaggtacaagacgaagactggcaatgctcttcctatgttttatgtctatgattcctatattaccaagcctgaaaaatgggccaatctgttaaccacctcagggtctcggagtattcgcaattctccttatgatggactgtttattgcccttctggtagaagaaaaacataagtatgatattcttcaaagtggttttgatggaatttacacatattttgccacaaatggctttacttatggctcatcacatcagaattgggctagcctaaaattattttgtgataaatacaacttaatatttatcccaagtgtgggcccaggatacatagataccagcatccgtccatggaacacgcaaaacactcggaaccgaatcaatgggaagtattatgaaattggtctgagtgccgcacttcagacacgccccagcttaatttctatcacctcttttaatgagtggcatgaaggaactcagattgaaaaagctgttcccaaaagaaccagtaatacagtgtacctagattaccgtcctcataaaccaggtctttacctagaactgactcgcaagtggtctgaaaaatacagtaaggaaagagcaacttatgcattagatcgccagctgcctgtttcttaatgcattgattaaagtttaatagttatcaaaatcacctaatttttaaaaatagctttcgttttgagttctggaaagaaaactgtcaaaatcagtatatactattagttatatttaaaaatatttttttaaattctttacagataatattatacttgttacccttcacaataccacatgagaaaatatctgagacaaaatgtatacaaatatattccttatggcataatttattgcatttctgactgaaatcaaaattctgatttgatggcaattgaattttcattttacaatagataaatgcttgtgctacctaaagcacttagcacacagttaaattatatttacatcctagacccaaataaataggattgtgtgtatatttgggatatctattgaagaaaaaaagaaaaccccttaaagataatgtacatgcttcatgtcatgtctttaaaataatttaatcaactttattgtcttagtatttagactctggataactctacaataatgaggaaattcttaagaataacaaaatcactgtaccttcctctcaattttgctgtgaacctgaaatggctttaaattaatactcttattttttatttaatttaattacataaattaaaccttaccatgaccaaattgtgttaggacggcctgctatctacagcacagtgtgtcatttgcagatttgtggttacctataccacgctaggtgttttgacatgtttagtgtttctgctttacagtgctgaattccatattttagaagctatgaaagtccttttatgaaaaagttactgattgcttctcagttattaggaaaacagttgtttcacaattattatgtagatatgatgcccaaatatcatttttagtatatcttgtcgatctttaagttgttactattgtgttattcatgtctttaaatcagataccaaatattttttaggaaagaaaaatgttattactgtcattaggttgtcttttaatactttaagttattttgacgaaaagtaatagagaaaatttacttagcattttagattctagagacatggaaatgaaaattattttatgtctagagtaggtcctgaagtttggctttacattaagtttagcactgtatcagaatgaagaaactaatattttacataaaaactaatactttcaattttttatatagtaatatccccattttgtaaatgttagacttttatcatacctgtaagttaaaatacttgttatcaataacttgtcatgttgtgacaaattgatcacttgtgtacgaaaaataaatctccttaaaaactaaataaaatgcactgtattcttacagttaatgtttataactatagtaaaaaattaatatatatcctattacataaatgttatttcttaggtgttccattaagaagagcaatagaataatgctaaaaaataatgcctataaatcttcagagtataaagacatccattcagaaacaaaaattagcactaaattttttataaaatagaccagatgacaaaatttattttatttttaaacagtggttttgacacaaattatgttattgaaaagcattattaatgtttaatttatttaaaattttggaatttgccatttctcagagaatgatcaggccttaggaaattaatacagtagtagtaatcattttctaggggaaaataaaagaataaatcactatactgatattttgatacaagcaagcacttacatggtaatcactatatagatccaacctgtggattttcttcttatgtccatttaactagaatatattattttaggtataatttacaaatgtcacacctaataatcttttataatataccatatttcattaaagttttgttagagaagtatctaccacagaggagtttttgtcattgtgtacgttgtgtatttgaacccaccatgacagaaagtaaattttaggaaatagttatgagattaagggaaaatctataaaaacaaggttagcatattctcaacacagataccaccactttctttttcccattatagacatggtgaatccacacagcatacttcatctctgagctttgttgtgattcctcaacacattaccctaaccagccagcagtaacagatttcagagtaagataaagcagattctgtcttcattgcaaaaagttattctcaatggaagaatggcatctgatctcataattactagtttatattaatatagtttttttctccctttttaataaaataattacagtcatccctcagtgtctgtgggggattggttccagttacccctatagataccaaaatctgcagatgctcaagtccctgatataaactggcatagtagttgcatataatctatgcacatcctcctgtatacattaagtcatctctagattatttataacacttaatacaatgtaaatgctatgtagttgttataccatactggttagtgaataattacatgaaaaaaaagagtctgtacatcttcagagtttcagtcggcaatttcttggccatggatgtagaacctacagataaggtgagccaactgcattaggaaataactctaataattctgttaattcttagagaggaaaactttcaaaatcttcctcaggtatttattacaactgcctttaccattttagttgtaacacagtttaaattgttatgataacaagtaaataagagcaaagaatgtatttcttaattcaaaactatacgtttgaattcaatatggtataacttaaagtggtataatacatacaatgcatgaatcataatggattcttttataagttattaatttttatggtttaatcagtctaattgttttgactgttatagaaaccaaatattttactgtttcttttaaggactaatattgtcaaaaactgctgttattaacttcacttgagttgtttaacttccttctgttttaagattgtaattaaaaattactattttgttatatggaatggttaatttttacctaataaaaacatagatgaaatacattgtatttta

SEQ ID NO: 17104 - DNA, 1076 bp, Homo sapiens
gtctgggctcggggcgcggcggcagtcagctctatgttcgcggtcttaacctctcctctggccgagtccttgcaagaagtgaattacccgaccctgcaaaacacttactattttggagtttaaagtatgtcatcatggcaaagtttcggagaaggacttgcatcattttggcactttttattctatttattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaaatcactatgaaaccttccaaagcctctgaacttaacttggatgaactaccacctctgaacaattatctacatgtattttattacagttggtatggaaatccacaatttgatggtaaatatatacattggaatcatccagtgttagagcattgggaccctagaatagccaagaattatccacaagggagacacaaccctccagatgacattggctccagcttttatcctgaattgggaagttacagttctcgggatccttctgtcatagaaactcacatgagacaaatgcgctcagcttcaattggtaattattgtatatatatatatgtgtgtttgtgtctgtatatatgcatataaatgattttttgtgtaactttactagttaattttctcattattattaattatattgttaagctcatacctccaaattaaactgtatgtatgatcttaaacatccaggcaaccacattttaacactgcccttagtgtatattgtttaatttttacattttggagcatttctggatatattgttgatttctaatttaattcactttctcaattttattaaattatgatttacataaaatacaatgaatttcccactttaagtttatagctcattgatgttactcaaaagtatatacctgtttgaataccaccccaatcaagaagtaaaatatttctatagcccaaaaa

SEQ ID NO: 17105 - DNA, 1069 bp, Homo sapiens
gtctgggctcggggcgcggcggcagtcagctctatgttcgcggtcttaacctctcctctggccgagtccttgcaagaagtgaattacccgaccctgcaaaacacttactattttggagtttaaagtatgtcatcatggcaaagtttcggagaaggacttgcatcattttggcactttttattctatttattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaaatcactatgaaaccttccaaagcctctgaacttaacttggatgaactaccacctctgaacaattatctacatgtattttattacagttggtatggaaatccacaatttgatggtaaatatatacattggaatcatccagtgttagagcattgggaccctagaatagccaagaattatccacaagggagacacaaccctccagatgacattggctccagcttttatcctgaattgggaagttacagttctcgggatccttctgtcatagaaactcacatgagacaaatgcgctcagcttcaattggtaattattgtatatatatatgtgtgtttgtgtctgtatatatgcatataaatgattttttgtgtaactttactagttaattttctcattattattaattatattgttaagctcatacctccaaattaaactgtatgtatgatcttaaacatccaggcaaccacattttaacactgcccttagtgtatattgtttaatttttacattttggagcatttctggatatattgttgatttctaatttaattcactttctcaattttattaaattatgatttacataaaatacaatgaatttcccactttaagtttatagctcattgatgttactcaaaagtatatacctgtttgaataccaccccaatcaagaagtaaaatatttctatagccc

SEQ ID NO: 17106 - DNA, 4492 bp, Homo sapiens
gcggggccggacgccggacaccagagcgcgggcggcggagccagcgggcgagagagcgcgcggcgggcgcgggttgccctcgtcgagagccatgggcgcggcgcggcgcggggctgaggatcggcgcggcccggaggcgctggggaccggggcgcgggcccggggccgcctttagccggcaccgagggcgcggggccggggatgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgcgtccggcctcgcccgcggctgctcgcaccaacaagtttgaacaatgatcaccgtcaaccccgatgggaagataatggtcagaagatgcctggtcaccctgagaccctttcggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggagtggatgcgtgcccgctggacctctgacccctgctacgccttctttggggtggacggcaccgagtgctccttcctcatctacctcagtgaggtcgagtggttctgccccccgctgccctggaggaaccagacggctgcccagagggcacccaagcccctccccaaagtccaggcagttttccgaagcaacctgtcccaccttctggacctgatgggcagcgggaaggagtccctgatcttcatgaagaagcggaccaagaggctcacagcccagtgggcgctggctgcccagcgcctggcacagaagctgggggccacccagagggaccagaagcagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacaccttcgggacggaacctgcgtacaaccacgaggagtacgccacgctgcacggctaccggaccaactggggctactggaacctcaaccccaagcagttcatgaccatgtttcctcatacccccgacaactccttcatgggcttcgtgtccgaggagctcaacgagacggagaagcggctcatcaaaggcggcaaggccagcaacatggccgtggtgtacggcaaggaggcgagcatctggaagctccaggggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagaagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcactagccacttccgcaggtgctgactcccgcactccctggcattttttgcagacaagggcttgggatggaccctcagccccatggtacgccctgcccagtttccagttgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtgggggaaagcaatagagacactctttttctctcttttttttaaagatttatttcttgaaataataaatattttattgggatgtg

SEQ ID NO: 17107 - DNA, 2761 bp, Homo sapiens
cccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccactgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 17108 - DNA, 3104 bp, Homo sapiens
ggcttttgactgactggatgtgggaatgttgtggaagacttctggcctgccatttcctgagaacgggactgctgagagaggagctgggaggagcactgcaaatttcactttggacacgtgagtcagagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagggaggtaacggacccctgagaggggcactgaagtctgcagtggggggggaggggcctggacacaccccttcccccccagactcctccccgtcagggtcagctcagccatggactttggacctggataagaagagagaagctgcactttggtggatctgatttgggattctcagttttgaaaatggagtgctgaatggggatttgatgatctcctggagagcaactgagacaagagaagaaaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccactgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaata

SEQ ID NO: 17109 - DNA, 3045 bp, Homo sapiens
agtctcttctgcccctccccctcctgtacggccgctactctgcgcccggcttccttctcacaacctggttctgcccacacctgttcttcagccctgtgaacagtggctgtagaacagtctcaggccctgcagacccacctccctcgctcccgtggtggcggtggtgacgggctggggacgttgggtagaaaaatgggcgggatgtggaacgctgcgttgccggggcccacttccggaggacgggcggaagtggctgcggtggatggttaacacagaaatctgcctcctgggccatgccgcttctaaggcctgtttcttctcatgagccccagactcctccccgtcagggtcagctcagccatggactttggacctggataagaagagagaagctgcactttggtggatctgatttgggattctcagttttgaaaatggagtgctgaatggggatttgatgatctcctggagagcaactgagacaagagaagaaaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccactgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctg

SEQ ID NO: 17110 - DNA, 1919 bp, Homo sapiens
ctgatcacatggcagcagcccttcttggggaagtcagctacccagcagcctgtagtcctcggctacccaccctcaccgcctggggtcccatggtgagacagctgggtgggcatcaggcttctgcagagggccaggccggagggagctgggcgagggagtggggctggctcctggcttgcaccggcctcgtggaatccaggcctcagacctgatcgctggcgaaactggctctgtgcgctggagcccctggtcttctgcgtctgtcctcctcccggccagactttactcctggctcagcgacaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccactgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataa

SEQ ID NO: 17111 - DNA, 3175 bp, Homo sapiens
gtgtggatggatgtgtgttgagagagagaatggatgtgtgtgtgtttacgaataaacttggaggggagggggcaacaggggtgggttttcgggctgagaaatgggaacactgtggggctgctgcaagcaggacttgggccttaaacattccaggagagtgttctcgggagtagccccgggaaggactttaacagaggttaacacagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagggaggtaacggacccctgagaggggcactgaagtctgcagtggggggggaggggcctggacacaccccttcccccccagactcctccccgtcagggtcagctcagccatggactttggacctggataagaagagagaagctgcactttggtggatctgatttgggattctcagttttgaaaatggagtgctgaatggggatttgatgatctcctggagagcaactgagacaagagaagaaaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccactgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctg

SEQ ID NO: 17112 - DNA, 2246 bp, Homo sapiens
agaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccactgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctg

SEQ ID NO: 17113 - DNA, 693 bp, Homo sapiens
gagagaagctgcactttggtggatctgatttgggattctcagttttgaaaatggagtgctgaatggggatttgatgatctcctggagagcaactgagacaagagaagaaaggtaaggctcctgtctcatttcccacttaatgtcttgctgtgcctgtgcagaaggtgttgagctggcgagttcgcggaggctactattcaggaaatcttatccagatgagtacactggaagctacacctctccattactctgtccaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccgg

SEQ ID NO: 17114 - DNA, 878 bp, Homo sapiens
ggcgagtcgaaaggcgaggcggccgcggcagcgcttgggacgcgcctgggcaccgggctcgctccctgcgccccggagcaggccaagttcggggccaggacgtcgggaggacctgagcctggcagagagcaggtgtgtgatacacgtcgtcaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtt

SEQ ID NO: 17115 - DNA, 564 bp, Homo sapiens
ctctcttcgctttctttactcagaactgaagctctcattccccacccaccaaggaaaaacaaaagggaagaagccacagctggccccggcttgctttggcacaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcg

SEQ ID NO: 17116 - DNA, 1104 bp, Homo sapiens
ggccagcgctggggatcgggcctggggcctggattgcgacccgcggcgggccgcggctcctagccgagacggggcgggcgggaaccaggttaacacagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagggaggtaacggacccctgagaggggcactgaagtctgcagtggggggggaggggcctggacacaccccttcccccccagactcctccccgtcagggtcagctcagccatggactttggacctggataagaagagagaagctgcactttggtggatctgatttgggattctcagttttgaaaatggagtgctgaatggggatttgatgatctcctggagagcaactgagacaagagaagaaaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctc

SEQ ID NO: 17117 - DNA, 572 bp, Homo sapiens
gaaagggctggcgagtcgaaaggcgaggcggccgcggcagcgcttgggacgcgcctgggcaccgggctcgctccctgcgccccggagcaggccaagttcggggccaggacgtcgggaggacctgagcctggcagagagcaggtgtgtgatacacgtcgtcaggtgactgaccgaggaattcagggcaaacagatcatctcaatttgccttgctgatgtgccagctgggattacgctgatggatgaagctcttcagagctatgggcaatatctacatatttgattgtcaagaaacttcgtgtggaaatagcttcaaacttacacaaattgcaagaataaaaaatagtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacct

SEQ ID NO: 17118 - DNA, 549 bp, Homo sapiens
aggcttttccatggtgcttccgccaaagcttgtgaccgagtccttcccgcctagggctggtgggcctcccctgctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcag

SEQ ID NO: 17119 - DNA, 555 bp, Homo sapiens
aaataaccgggagacaagctttcggaggcttttgactgactggatgtgggaatgttgtggaagacttctggcctgccatttcctgagaacgggactgctgagagaggagctgggaggagcactgcaaatttcactttggacacgtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgc

SEQ ID NO: 17120 - DNA, 619 bp, Homo sapiens
gatgtcaggggcgtgggtcctgatcacatggcagcagcccttcttggggaagtcagctacccagcagcctgtagtcctcggctacccaccctcaccgcctggggtcccatggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcatt

SEQ ID NO: 17121 - DNA, 607 bp, Homo sapiens
gaaaagagccacgaaataaccgggagacaagctttcggaggcttttgactgactggatgtgggaatgttgtggaagacttctggcctgccatttcctgagaacgggactgctgagagaggagctgggaggagcactgcaaatttcactttggacacgtgagtcagaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggt

SEQ ID NO: 17122 - DNA, 3183 bp, Homo sapiens
atgtagggataatctttatagatgcaatttagccctgccaaaagtctgtttataatgatgaatagtaaatgaagaaacttacattttgcattaccgaatgagcttgactttctcttttcccctgaataggaagggaaaaggccgaggcatcagcgtgtgaagaccgcaaagacgatcccgagtacagttgtgaacagcattgctgctaggctcctcctgcagatcatctgaaatgaacctctcttattgatttttattggcctagagccaggagtactgcattcagttgactttcagggtaaaaagaaaacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaagaaaaactgattgcttatcaacgagaattccttgctttgaaagaacgtcttcgaatagctgaacacagaatctcacagcgctcttctgaattaaatacgattgtgcaacagttcaagcgtgtaggagcagaaacaaatggaagtaaggatgcgttgaataagttttcagataataccctaaagctgttaaaggagttaacaagcaaaaaatctcttcaagtgccaagtatttattatcatttgcctcatttattgaaaaatgaaggaagtcttcaacctgctgtacagattggcaacggaagaacaggagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagattcatattaaaaaagccaccaactgatcatctgagaaaccaacacattttttcctgtgaatttgttaattaaagatagttaagcatgtatcttttttttatttctacttgaacactacctcttgtgaagtctactgtagataagacgattgtcatttccacttggaaagtgaatctcccataataattgtatttgtttgaaactaagctgtcctcagattttaacttgactcaaacatttttcaattatgacagcctgttaatatgacttgtactattttggtattatactaatacataagagttgtacatattgttacattctttaaatttgagaaaaactaatgttacatacattttatgaagggggtacttttgaggttcacttattttactattatagaccctcttttatagattatcagggattatatatataaatatataaatatacataaaaatgttatggaattaatttattagaaacacttaagaagtacatatttttgtgcagtagatttttgaatcgatactttttttgaaaaccagtttccttgcttttttaagttctttctatatttttctttggaaatgcaaacattacaaaccaatgccatttttcaaatgcactgccatttaagattgattatagatggatttcttaattgaagtacttttataatcacagtgactgaacaaaatattttcaaagacatttgtcattccttaaagccaagattttaaagactaatgtccttcctgagggttactttactatactgtgtatggtgtatagccacagaaagtcagtctgataaattttcaatgtgtaagtgtgatgcattcaacccagattattgtagacttaacttattatatttcctctgatatgtaaaatgacaaactcttctttcctttttaatctttgtctttaatccatgaattaggtgcattatctgctgttgattcttttatatctgcactcattttatgacgtcagacaaaatgttttctaggtgttgctattgtatgagtcataattggtataattttaaagaaaattgtaatattgttttttggtgaaatatattattagtagtatattttccaaaatgattttattgtagtatgaactgataagtgagtcccgtgtccaagagactgtatttattactcttaaacacgctattccaaatgatattactactataaacaaagaatattaccggtctcagcaa

SEQ ID NO: 17123 - DNA, 8382 bp, Homo sapiens
cgcagcggcggcggcagcggcggcggcggctacagcagctccgccggcagccgcgggagcacggcgacgccagcggcgggaagggaaaaggccgaggcatcagcgtgtgaagaccgcaaagacgatcccgagtacagttgtgaacagcattgctgctaggctcctcctgcagatcatctgaaatgaacctctcttattgatttttattggcctagagccaggagtactgcattcagttgactttcagggtaaaaagaaaacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaagaaaaactgattgcttatcaacgagaattccttgctttgaaagaacgtcttcgaatagctgaacacagaatctcacagcgctcttctgaattaaatacgattgtgcaacagttcaagcgtgtaggagcagaaacaaatggaagtaaggatgcgttgaataagttttcagataataccctaaagctgttaaaggagttaacaagcaaaaaatctcttcaagtgccaagtatttattatcatttgcctcatttattgaaaaatgaaggaagtcttcaacctgctgtacagattggcaacggaagaacaggagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagattcatattaaaaaagccaccaactgatcatctgagaaaccaacacattttttcctgtgaatttgttaattaaagatagttaagcatgtatcttttttttatttctacttgaacactacctcttgtgaagtctactgtagataagacgattgtcatttccacttggaaagtgaatctcccataataattgtatttgtttgaaactaagctgtcctcagattttaacttgactcaaacatttttcaattatgacagcctgttaatatgacttgtactattttggtattatactaatacataagagttgtacatattgttacattctttaaatttgagaaaaactaatgttacatacattttatgaagggggtacttttgaggttcacttattttactattatagaccctcttttatagattatcagggattatatatataaatatataaatatacataaaaatgttatggaattaatttattagaaacacttaagaagtacatatttttgtgcagtagatttttgaatcgatactttttttgaaaaccagtttccttgcttttttaagttctttctatatttttctttggaaatgcaaacattacaaaccaatgccatttttcaaatgcactgccatttaagattgattatagatggatttcttaattgaagtacttttataatcacagtgactgaacaaaatattttcaaagacatttgtcattccttaaagccaagattttaaagactaatgtccttcctgagggttactttactatactgtgtatggtgtatagccacagaaagtcagtctgataaattttcaatgtgtaagtgtgatgcattcaacccagattattgtagacttaacttattatatttcctctgatatgtaaaatgacaaactcttctttcctttttaatctttgtctttaatccatgaattaggtgcattatctgctgttgattcttttatatctgcactcattttatgacgtcagacaaaatgttttctaggtgttgctattgtatgagtcataattggtataattttaaagaaaattgtaatattgttttttggtgaaatatattattagtagtatattttccaaaatgattttattgtagtatgaactgataagtgagtcccgtgtccaagagactgtatttattactcttaaacacgctattccaaatgatattactactataaacaaagaatattaccggtctcagcaatcagtgatctttataaaagtacttttaaaaaatgatgaattatcaccaggcgctgtggctcacgcctgtaatcccagcactttgggaggccgaggcgggcggatcacgaggtcaggagatcaagaccatcctggctaacacggtgaaaccctgtctctactaaaaatacaaaaaattagccaggcgtggtggcaggtgcctgtaatcccagctacttgggaggctgaggcaggagaatggcgtgaacccaggaggcagagctggcagtgagctgagatcgcaccactgcactccagcctgggcgacacagctagactccgtctcaaaaaaaaaaaaagatgaagtatcaacatcagttcccagccagtctgcttggacacactggggtgccacaagtgggttgcaggttggttgcagacgggcagagatggattctgctgagctttcagagtgaccactggctggggcctagcgctggggcaaggttccagctggctgcctctagcctggaggagcttcatctagttacccaatgtgctgaaccaacagcatgaaatagcatcatttcctgtgctgtgttacaaagtgcaaacgtttggaaacactgatacagtacaattatttccatcactccatgttgttataatttttagttacttttcttgattgaaaagtcaatcacattgccaaaaatgatttttatgtcagttaaaggccagttgaaatttttttattaggatgttttaaatttacttttcactttcttgaatttttttcttctcaaatttccttggcccagtgcccatgagcaaatttcattcaaaaacaggaataaccttttgtcataaaattttggcaccagcttggtatactaaattactgcaaagataactgagtaccagaagtaaaaatctctgcaggtgggcttaggagtactcttgggtccctggttcctcagttgccaactctggtttcatgaagaaagaccatgctctgaaaatctagggaggagaaagttattgcagcacctggtgtgatttgttacaacttctttaaagacagcctgcctggctagctttttcctgttttcatgcagtttgccctcccagcattggtccacctgttgttcccaagaaactcattcttgttcccaagactccttttagccaaatctttcctatcattccaggacttttttgtgcttctctccccatgaatctacccgtgcctagggtgtgtgccaggcacgtggcaggtggccagtcagcatctggatgtgagaccaattattccagcctgccctcctctttctctttttatcattttgtattatttttgagacagggtctcgctttgttgcccaggctggagtgcagtggtgctctcatagctcactgcagcctcgatctctggcctcaagcaatcctcctgcctcagcctcccaaagtgctgggattataggtgtgtgccaccatgtccagccccctttctctctcttaactccctctccctgctgtcgttgccatactcttgcatacacaatcggttgtctagtttttgattgtttgtgtgtatggtgtgtgctgtctctctgaccagatttcaggttcctgaggcgagcctgcagctcatactgctcatctgtcctctcctatggtgggtgctcagggcctctcactgttagttactccctcctttctgcccagttctgcactcaactagtagaagcagccatcctttccccaagcaggaaattgtagtggtcgcccttaagagcagtgtgagggcagaagattaagggaggggaagagtccctggaactggaagaaggtaaatactttgccttgagagggcgccgaatcattttaccaaaatagtaaatggaaaaagtgtcaaaggttgggactagttttaaaaacacatatagccagtagacacatgggggctgtttaaataaaaacatttttttacccggttctgccatcacacacactagtgacattccaagtactcagtggccatgtggagctagtggccaccacacttgacaccacggatgcagaacttttccatcactgcagaaagctctgttgaacagtactgtgtccagagtgctaattatgaacagcttagaaaccacaattaatacattctcatgaggttaaaagcagacatgggaatagaacataatgcaaatgatgatgaatattttgggtgagaagagaaagctgaggacccatttctaggattctaagatgtaagatttcttaagttctttatcttagtctcatgcattctccacatcacgcgctgtaccatactgtgtagtcagaacagacagtgtgattgaaaagctttggaaaaagttaacacaaaggattatttagcacataggctgtagatacgtatgtgtgtatttgttcaacaattggagatggttgaatacccttgaacaaagtgtgtatcttctcaaatcagtggttgcactagtcaataattagaaggtgttgttatttttaaaactataagcaaaattatgaaggcctttaaaaaatctatcataataatgaaaaagaggttgtctcccaacagtgctgtccctcaaagaaaagactggttatgtggaaacagcacgtttggagagattattctagtgaataacagtgtatatttgtggtaggcaaatttctaagaatgacccctactgacacccccaccaatgaccttgtataatatcctcccactttgagcatgggtggaacctgtttgatccatgattatatcatgttatgtagcaaaaggaagactgtctgggggtggctaatcaaatcttgtgactcctttaaaagcagagagttttctcgggctggtggcagaagtcaagagacaaagcagaaggacctcaggcaccattgctgttttaaggtagagggggctgcatgagaaggaatgcacatggctttgaggagctgagagaggccttggctaacagcaaaggagctgggaactgcagtcctacagccacgggaactgaattcagcccataagctcattcataggcttggaaaggcattcatctccagtctccagataagacccagcctggccaacactttgaatccagccttgtgagaccctaagccgagaactcacttaagcctgcttggacttctgacctacagaactatgagataataaatcagtggtgttttaagctgctaaatttgtggcaatttgttatgtaggaataggaaatgaatacagtattttaaaagaggtaaagaggaaatcttcatacttgattccctgtagtatgctggatatttcttggtaaatgcatgaataaagtctttagtagcaagtcatgtacctggaccttgttggggatgttctcgccagagatctcaattagtcttcattggacgtttgttggcaaagttgcagcatcttactgagtagcgtttggtaaaggaactgctagaatgagactataggaataggactgaaacagtgtgtaagggatcttttttatttctagaagaggtgttactttatactgatttagactgctctgagcctgtcagaagtaaattcaagaatgattaacagtggtattttagatacattaagagcaaaaataacctttgccttgtagagatcagataatctgtgtatcgagggatttaattttttttaaccaaaacttagtttctctttttatcatctagcacagatcaaatcctgtatgggccagccaaatgtttgtagtttgagaatgttttgcaaatacctctctgcttccaagccattaatagctaatgaagttttattttggtttgtccattaatttttctgcttatttttactgtattgccatgtccttgatacgagacaagtagaactaaaagagagaaaatgagaggttaagactgtcagaagatgagaaatgtgagtcataaccataccttagtgttttaagggaactttatccagtccaatccctttatagaaaaggaacttttccaagttatgttgcagtatttatagtgtgtaaaattttgtttgactttggtagttgtgcattttaaattatgaatcttatatgctacgataactagtatgcttactttctttaatgcatgtgatcatacaatgctaaaaaggtattttttaaagacccaaccaaactgaggattttgttatacatatctgtatcaacacctatatataaactcttcttcttacctgaaacactccttcacccggtttgggcactaactagatcattttcaaaggaacaaacaggaaggagcaagctggcactccagggtgcatctgagctgagaatttagaagacctcattcaagaaagtaaactgagcattgatgggaaagcactttgcgcgaagtaacattcccactgttaatgttgcagtcaaaattgtggaaaaaaaaaagtggtgctaaaattgttctgaaatgaagattgtttgttgtggggaatattttaatactcttggactttagggaggctattttatgtgtcacttgctcctagttgtttcattgtattagtaattagcaaactgtcctggaaccaagggtttggtacttttgcctgattagcattccattatttatttgaaatgctcagtgtttgctcaaatttggtgaaaatatcttttgaagacatattctctgagccttaaaaatggctgctatcgacagtactgtaagatgcactgccagtagatttgatacttttcatttcagtgtaggcagtaatgttttctaagaaagatttagaaatcagcaaagtgtaacaattgtgtttcatttatggaatggaaaaactgaagtgtcccattcagaacactttggaaaggttgtctgcattaggggatgtttctggaagcatcccttagagaagctgcctgaggaatctccttgccaggttgtaccagatttttttttttcttaaatgtattgtatatattttccttaaaatgtcttcattggctgaatgattcctatccgtagtaatattttaggtacttgttggatttttaaaggaagattatttattttcagatttgctgctataattgaaaacctagtaactggtcctgttgattgtgccttcatcactgtttctctgtgccacgaccgttcatgtgtatttgaaataaagaagtttaaaaagccatgttgaattcaagattccttctaataaaaataggtgaaacttaa

SEQ ID NO: 17124 - DNA, 2018 bp, Homo sapiens
aaaatcagtcaccataactttctttttacagacaaaacaaaaccaatgaggagggaatatagtttgaagctgttttgtatttttttccaggaggagaaggaccatataattccagaagggaaaaggccgaggcatcagcgtgtgaagaccgcaaagacgatcccgagtacagttgtgaacagcattgctgctaggctcctcctgcagatcatctgaaatgaacctctcttattgatttttattggcctagagccaggagtactgcattcagttgactttcagggtaaaaagaaaacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaagaaaaactgattgcttatcaacgagaattccttgctttgaaagaacgtcttcgaatagctgaacacagaatctcacagcgctcttctgaattaaatacgattgtgcaacagttcaagcgtgtaggagcagaaacaaatggaagtaaggatgcgttgaataagttttcagataataccctaaagctgttaaaggagttaacaagcaaaaaatctcttcaagtgccaagtatttattatcatttgcctcatttattgaaaaatgaaggaagtcttcaacctgctgtacagattggcaacggaagaacaggagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagattcatattaaaaaagccaccaactgatcatctgagaaaccaacacattttttcctgtgaatttgttaattaaagatagttaagcatg

SEQ ID NO: 17125 - DNA, 3709 bp, Homo sapiens
agttgtaaaatacagtttgctgtttatacttcgcagccattcattttttagtgtgaagtttaatgtctttcatttttatcagttctttttttcttatggttaagccatgtgaaaatgaattacagtattacagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagcagagagttttctcgggctggtggcagaagtcaagagacaaagcagaaggacctcaggcaccattgctgttttaaggtagagggggctgcatgagaaggaatgcacatggctttgaggagctgagagaggccttggctaacagcaaaggagctgggaactgcagtcctacagccacgggaactgaattcagcccataagctcattcataggcttggaaaggcattcatctccagtctccagataagacccagcctggccaacactttgaatccagccttgtgagaccctaagccgagaactcacttaagcctgcttggacttctgacctacagaactatgagataataaatcagtggtgttttaagctgctaaatttgtggcaatttgttatgtaggaataggaaatgaatacagtattttaaaagaggtaaagaggaaatcttcatacttgattccctgtagtatgctggatatttcttggtaaatgcatgaataaagtctttagtagcaagtcatgtacctggaccttgttggggatgttctcgccagagatctcaattagtcttcattggacgtttgttggcaaagttgcagcatcttactgagtagcgtttggtaaaggaactgctagaatgagactataggaataggactgaaacagtgtgtaagggatcttttttatttctagaagaggtgttactttatactgatttagactgctctgagcctgtcagaagtaaattcaagaatgattaacagtggtattttagatacattaagagcaaaaataacctttgccttgtagagatcagataatctgtgtatcgagggatttaattttttttaaccaaaacttagtttctctttttatcatctagcacagatcaaatcctgtatgggccagccaaatgtttgtagtttgagaatgttttgcaaatacctctctgcttccaagccattaatagctaatgaagttttattttggtttgtccattaatttttctgcttatttttactgtattgccatgtccttgatacgagacaagtagaactaaaagagagaaaatgagaggttaagactgtcagaagatgagaaatgtgagtcataaccataccttagtgttttaagggaactttatccagtccaatccctttatagaaaaggaacttttccaagttatgttgcagtatttatagtgtgtaaaattttgtttgactttggtagttgtgcattttaaattatgaatcttatatgctacgataactagtatgcttactttctttaatgcatgtgatcatacaatgctaaaaaggtattttttaaagacccaaccaaactgaggattttgttatacatatctgtatcaacacctatatataaactcttcttcttacctgaaacactccttcacccggtttgggcactaactagatcattttcaaaggaacaaacaggaaggagcaagctggcactccagggtgcatctgagctgagaatttagaagacctcattcaagaaagtaaactgagcattgatgggaaagcactttgcgcgaagtaacattcccactgttaatgttgcagtcaaaattgtggaaaaaaaaaagtggtgctaaaattgttctgaaatgaagattgtttgttgtggggaatattttaatactcttggactttagggaggctattttatgtgtcacttgctcctagttgtttcattgtattagtaattagcaaactgtcctggaaccaagggtttggtacttttgcctgattagcattccattatttatttgaaatgctcagtgtttgctcaaatttggtgaaaatatcttttgaagacatattctctgagccttaaaaatggctgctatcgacagtactgtaagatgcactgccagtagatttgatacttttcatttcagtgtaggcagtaatgttttctaagaaagatttagaaatcagcaaagtgtaacaattgtgtttcatttatggaatggaaaaactgaagtgtcccattcagaacactttggaaaggttgtctgcattaggggatgtttctggaagcatcccttagagaagctgcctgaggaatctccttgccaggttgtaccagatttttttttttcttaaatgtattgtatatattttccttaaaatgtcttcattggctgaatgattcctatccgtagtaatattttaggtacttgttggatttttaaaggaagattatttattttcagatttgctgctataattgaaaacctagtaactggtcctgttgattgtgccttcatcactgtttctctgtgccacgaccgttcatgtgtatttgaaataaagaagtttaaaaagccatgttgaattcaagattccttctaataaaaataggtgaaactt

SEQ ID NO: 17126 - DNA, 2446 bp, Homo sapiens
cgcggctctcgccgcccagcccagcccagcccggcccggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggtccccgcccggccccgggccccccgcccctccccgacccggggccggggcccctgccgccgccgccgccgccttccgacccctgcgccccggccccggtcccccgggccatgcagcctcggccccgcgggcgcccgccgcgcacccgaggagatgaggctccgcaatggcaccttcctgacgctgctgctcttctgcctgtgcgccttcctctcgctgtcctggtacgcggcactcagcggccagaaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctcaaa

SEQ ID NO: 17127 - DNA, 3027 bp, Homo sapiens
ctctggggtctgtgaagccaccaaggatcaaggaatggaagagctgcctgagtgtagagggagttcggtcaggcttcttaaacttggagacttggaaacagaaggccttgtaggccacataggttttcagagactcgcctggcagaggcctggagcgtcctgctgcgtggactgtgggcaccgagccaccaggaggttgttgatctcattcttgctcactggtccctgccagactggtggtgcctctctactgtcgggcagccccacctctgtgctgccccatccacctacagccctcatgcctgggcccagctggaggttctgacaggggccccctggggtggcatgcggacccttcagggtgccccaggcgcagcacaggtctccagagacacaggcaccagggcgttcagagctagtcccctcgctgctgttgactgtccttgagcagccccagggccggtttctcaacctcatttgctcacctgagcaatgaagtgaggtgggctcctggaactgcagcagccaccccccggggccatcgtgaggctaagaatccagtgcagggtgagcaaccagcgaccgctacaaggacagtgaagagctagcaccaggaccttgggtagcccacccgctggagggagcgtgtgctgcaaaaagcaagagtgggctttggaggccaacggatggagcggattcagtctgaggctgttccagcccttgcttaggatccacctacctaggtctggaaatcgtatttccacttcagatgccttctcagaggataaaataacccccggtgggggagagtactggaagagggctaattcccctggttttctccccatgagcattagtgtcagtgtaattttagagtgaccccagctatgtcacgtgtggcaggcacaagaacagatgtcaatgagctattgcagaggtggacacccagatgtgtgcgctggcacactggaggggcccgtagggtggctctagaccgccccctcgtgacggcttgcctaccacctgcaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctcaaa

SEQ ID NO: 17128 - DNA, 2710 bp, Homo sapiens
gggccggagggccgcggtgtgccgcggggcagttgcgggttgtcataacggtccccgccggagtgaggcgaggccgcgtcgctcagttctggccgtctagggcccctgtaaggatgagagcgcagaggacgcagggccgctggaggcgcaggtaacgaagctagggtgcggttgggaccgcggctgagctttttccgggacccgtggtgctgaatggagaggacggagacgaagccgagccgcggctcctagcggcggcgccgatgctcgagctgtagctgccaggcgaggatgtgtggagcgcaggcggcgcggggtaaatgagaggtctcgggccccaggacccccggggcccgggatgagttagcgagggcagccgcgggggccagttccgaccgtgacaggccaaggcgacggccgccgcccgcccgccccttccgtgcagaagcagctgctcctttccgcgcccgcccgcctgcgctcccggccctggagaccatgaggttccgcatctacaaacggaaggtgctaatcctgacgctcgtggtggccgcctgcggcttcgtcctctggagcagcaatgggcgacaaaggaagaacgaggccctcgccccaccgttgctggacgccgaacccgcgcggggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatgtagataaggctggcacctgggccccccgggagctggtgctggtggtccaggtgcataaccggcccgaatacctcagactgctgctggactcacttcgaaaagcccagggaattgacaacgtcctcgtcatctttagccatgacttctggtcgaccgagatcaatcagctgatcgccggggtgaatttctgtccggttctgcaggtgttctttcctttcagcattcagttgtaccctaacgagtttccaggtagtgaccctagagattgtcccagagacctgccgaagaatgccgctttgaaattggggtgcatcaatgctgagtatcccgactccttcggccattatagagaggccaaattctcccagaccaaacatcactggtggtggaagctgcattttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactggtttctgctttaatacaaaaacaaaatcttgtaaaaggtgtccaaatacatagtaatcttttccagttatgtctgattaagatttaaaactgaaggtttcattttgggagtagggttttaaagctcaatctgttatctgctaaaattgattattgttgatatgagagaagaggggaaattttatttaaattgcatttattaatctttttatctgaaactttgtacacttttccactttcaaaacctattttaagtacagcaaaatttatttaaaactgtcatagcagtaaaaagtattacgatgaaattgttagggtattaatggaacaaacccagtttcactctcttgacacacttattaggaagggattgcttcactggtttaataatttaaaagttatgtttgttaaacaccctgtcagaacagtcattttcagtattagattcctgtactattgtgttttgagtgtgttttggaaccttcatagaacacactttcttttggaatgtatttgattgataagaaagtttaaacattgttttcacctcaatgtagaaatacagtggttttgtttttttttttcttttagtgctgacaaaataaaatactcatttttgcataaaaaggttcctaatccttttgcagaataagttttgtttactctttataccaaaattcagtgaaggcattctacaagttttgagttagcattacattttaatatttactattgctacattgtataattgagtttgaaataaaacccagcttatgacaatgc

SEQ ID NO: 17129 - DNA, 1784 bp, Homo sapiens
ataacggtccccgccggagtgaggcgaggccgcgtcgctcagttctggccgtctagggcccctgtaaggatgagagcgcagaggacgcagggccgctggaggcgcaggtaacgaagctagggtgcggttgggaccgcggctgagctttttccgggacccgtggtgctgaatggagaggacggagaccatgaggttccgcatctacaaacggaaggtgctaatcctgacgctcgtggtggccgcctgcggcttcgtcctctggagcagcaatgggcgacaaaggaagaacgaggccctcgccccaccgttgctggacgccgaacccgcgcggggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatgtagataaggctggcacctgggccccccgggagctggtgctggtggtccaggtgcataaccggcccgaatacctcagactgctgctggactcacttcgaaaagcccagggaattgacaacgtcctcgtcatctttagccatgacttctggtcgaccgagatcaatcagctgatcgccggggtgaatttctgtccggttctgcaggtgttctttcctttcagcattcagttgtaccctaacgagtttccaggtagtgaccctagagattgtcccagagacctgccgaagaatgccgctttgaaattggggtgcatcaatgctgagtatcccgactccttcggccattatagagaggccaaattctcccagaccaaacatcactggtggtggaagctgcattttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactggtttctgctttaatacaaaaacaaaatcttgtaaaaggtgtccaaatacatagtaatcttttccagttatgtctgattaagatttaaaactgaaggtttcattttgggagtagggttttaaagctcaatctgttatctgctaaaattgattattgttgatatgagag

SEQ ID NO: 17130 - DNA, 4232 bp, Homo sapiens
gcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgcgtccggcctcgcccgcggctgctcgcaccaacaagtttgaacaatgatcaccgtcaaccccgatgggaagataatggtcagaagatgcctggtcaccctgagaccctttcggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggagtggatgcgtgcccgctggacctctgacccctgctacgccttctttggggtggacggcaccgagtgctccttcctcatctacctcagtgaggtcgagtggttctgccccccgctgccctggaggaaccagacggctgcccagagggcacccaagcccctccccaaagtccaggcagttttccgaagcaacctgtcccaccttctggacctgatgggcagcgggaaggagtccctgatcttcatgaagaagcggaccaagaggctcacagcccagtgggcgctggctgcccagcgcctggcacagaagctgggggccacccagagggaccagaagcagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacaccttcgggacggaacctgcgtacaaccacgaggagtacgccacgctgcacggctaccggaccaactggggctactggaacctcaaccccaagcagttcatgaccatgtttcctcatacccccgacaactccttcatgggcttcgtgtccgaggagctcaacgagacggagaagcggctcatcaaaggcggcaaggccagcaacatggccgtggtgtacggcaaggaggcgagcatctggaaggggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagaagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcactagccacttccgcaggtgctgactcccgcactccctggcattttttgcagacaagggcttgggatggaccctcagccccatggtacgccctgcccagtttccagttgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtgggggaaagcaatagagacactctttttctctcttttttttaaagatttatttcttgaaataataaatattttattgggatgtgaggtgc

SEQ ID NO: 17131 - DNA, 1759 bp, Homo sapiens
gcggggccggacgccggacaccagagcgcgggcggcggagccagcgggcgagagagcgcgcggcgggcgcgggttgccctcgtcgagagccatgggcgcggcgcggcgcggggctgaggatcggcgcggcccggaggcgctggggaccggggcgcgggcccggggccgcctttagccggcaccgagggcgcggggccggggatgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgcgtccggcctcgcccgcggctgctcgcaccaacaagtttgaacaatgatcaccgtcaaccccgatgggaagataatggtcagaagatgcctggtcaccctgagaccctttcggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggagtggatgcgtgcccgctggacctctgacccctgctacgccttctttggggtggacggcaccgagtgctccttcctcatctacctcagtgaggtcgagtggttctgccccccgctgccctggaggaaccagacggctgcccagagggcacccaagcccctccccaaagtccaggcagttttccgaagcaacctgtcccaccttctggacctgatgggcagcgggaaggagtccctgatcttcatgaagaagcggaccaagaggctcacagcccagtgggcgctggctgcccagcgcctggcacagaagctgggggccacccagagggaccagaagcagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagaggcaaaggagactgaggagtagccaagagcaagccagatgtggagtcatgggtgcctgtgagaagatgcttctagaaggagatgtggccagcaacacattgctcattgaaaagccaagtaagaaggagactgaaaaatgtccaaagaatttggtcacatga

SEQ ID NO: 17132 - DNA, 4054 bp, Homo sapiens
gccagcatcttgtagttgagctctctttatcctatagtgggggggccctcctgggtctggagctcagcccccatcctttcattctcccttgcttccttcactcatgcactcattcgtaaaacatttgtgcagccggtacgtggtggagcgtcagggcacgatggcccttcctgccctcctgacccgcctccttcctctccgcaggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggagtggatgcgtgcccgctggacctctgacccctgctacgccttctttggggtggacggcaccgagtgctccttcctcatctacctcagtgaggtcgagtggttctgccccccgctgccctggaggaaccagacggctgcccagagggcacccaagcccctccccaaagtccaggcagttttccgaagcaacctgtcccaccttctggacctgatgggcagcgggaaggagtccctgatcttcatgaagaagcggaccaagaggctcacagcccagtgggcgctggctgcccagcgcctggcacagaagctgggggccacccagagggaccagaagcagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacaccttcgggacggaacctgcgtacaaccacgaggagtacgccacgctgcacggctaccggaccaactggggctactggaacctcaaccccaagcagttcatgaccatgtttcctcatacccccgacaactccttcatgggcttcgtgtccgaggagctcaacgagacggagaagcggctcatcaaaggcggcaaggccagcaacatggccgtggtgtacggcaaggaggcgagcatctggaaggggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagaagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcactagccacttccgcaggtgctgactcccgcactccctggcattttttgcagacaagggcttgggatggaccctcagccccatggtacgccctgcccagtttccagttgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtgggggaaagcaatagagacactctttttctctcttttttttaaagatttatttcttgaaataataaatattttattgggatgtgaggtgc

SEQ ID NO: 17133 - DNA, 5062 bp, Homo sapiens
acggggtggaagtgggggtggggggaggggatcggggccgggccggggccgcgctgcctgcgatgccgggcgcccgccgcagccgctgccgccggagcccgggatggggcgagaggctgcggcggacgccagcatctccccgccggggaccccgggggccgcggagccgccgccgccgctgctgccgccgttgctgagacccagcgggcgatgggatgaagatgagacgctacaagctctttctcatgttctgtatggccggcctgtgcctcatctccttcctgcacttcttcaagaccctgtcctatgtcaccttcccccgagaactggcctccctcagccctaacctggtgtccagctttttctggaacaatgccccggtcacgccccaggccagccccgagccaggaggccctgacctgctgcgtaccccactctactcccactcgcccctgctgcagccgctgccgcccagcaaggcggccgaggagctccaccgggtggacttggtgctgcccgaggacaccaccgagtatttcgtgcgcaccaaggccggcggcgtctgcttcaaacccggcaccaagatgctggagaggccgcccccgggacggccggaggagaagcctgagggggccaacggctcctcggcccggcggccaccccggtacctcctgagcgcccgggagcgcacggggggccgaggcgcccggcgcaagtgggtggagtgcgtgtgcctgcccggctggcacggacccagctgcggcgtgcccactgtggtgcagtactccaacctgcccaccaaggagcggctggtgcccagggaggtgccgcgccgcgtcatcaacgccatcaacgtcaaccacgagttcgacctgctggacgtgcgcttccacgagctgggcgacgtggtggacgcctttgtggtgtgcgagtccaacttcacggcttatggggagccgcggccgctcaagttccgggagatgctgaccaatggcaccttcgagtacatccgccacaaggtgctctatgtcttcctggaccacttcccgcccggcggccggcaggacggctggatcgccgacgactacctgcgcaccttcctcacccaggacggcgtctcgcggctgcgcaacctgcggcccgacgacgtcttcatcattgacgatgcggacgagatcccggcccgtgacggcgtccttttcctcaagctctacgatggctggaccgagcccttcgccttccacatgcgcaagtcgctctacggcttcttctggaagcagccgggcaccctggaggtggtgtcaggctgcacggtggacatgctgcaggcagtgtatgggctggacggcatccgcctgcgccgccgccagtactacaccatgcccaacttcagacagtatgagaaccgcaccggccacatcctggtgcagtggtcgctgggcagccccctgcacttcgccggctggcactgctcctggtgcttcacgcccgagggcatctacttcaagctcgtgtccgcccagaatggcgacttcccacgctggggtgactacgaggacaagcgggacctgaactacatccgcggcctgatccgcaccgggggctggttcgacggcacgcagcaggagtacccgcctgcagaccccagcgagcacatgtatgcgcccaagtacctgctgaagaactacgaccggttccactacctgctggacaacccctaccaggagcccaggagcacggcggcgggcgggtggcgccacaggggtcccgagggaaggccgcccgcccggggcaaactggacgaggcggaagtctagagctgcatgatctgatagggtttgtgacagggcgggggtggcggcggcccctagcgctatctccctgcctcctgccggctccttggttcttgaggggaccaggagtgggtggggagtgggggtgggggtagggtttccctactgaagcccttgtgaatcaagggtcaggcctttgagctcagaaaatatccctcctgttgggagagggcgcaggccgtgacgtctgggtggcccttatgactgccaagactgctgtggccaggaggtgccactggagtgtgcgtggtggtccctgggtagcgggggagggtaggcaggattggggaagagagcctgcaggatctcaccaggcagcctctggggggtggccaggccgggaaaaagcccaccatttggcatccctgggccttgggctccgtgtgggagaccggcctgccaggaggacccagggctctgtaagtagatgcatttgggtccaggaggaagcgtggacacctcgtagggaagagatgaaaaagccacatcctaccaagaggaggtgctgagggatgctttgcagtgtagtcagaagtgctgggccagatggagacagaactccaccccctgccgcaaaggacaggacctggctgccctgggatgctggtgcctgagtctgtctctgtgcacccctcaggctgtcgtgagccaacacaggggcctggagaaccctgaggagctttccttttggttctaaacccggcgttgacgttccttctccctttcacattgctgtcttgtggactgtgcactcagtccttgcaaggccaagagtccagttgtaggtgtggccttgagggggaagtggggaggagaagactgacatgagtcctctgcacggatccgtctctccctccccatcaccccttccttctgacacccagtcccagctgtccactgtcccaggtgcagtcactgttgtgcccttccttggggcaggctggctgggggccagaaaggggccatgaggctgtcttgggcccaaaaagggacaataaggccagttgtatgcttcctgttcctcatagcttgccttggtggggatgtctttgttggagttgattctgagctgctgtgattaggagaccctgaaatacagtggtttaagcaagatggaagcttgtttctaattagtctagattgagatggcccagagctggtagggcagctctgcgtttcttcatacgcaccttccaattctgggtacacagcggctgctccagcgcccaccctcctgtgtgcatccaagcctgggggaagcagaaatagacaagagggcacacccactttttgctaaaggcatgagccagaattggcaggctcacctctgctggcctctcattggctgggactcagtcacatggccacaagcagctgctagggaacctgggaagtgtagtcttcagcggggccgccatgtgcctggcctcaccttgggagttatcttattgatggaggagaagagaatggatatgggggaccagtagcatctctgggagagggggagggagcagcaataactcagtcgtcggatccagctctcattgtcagagtttccggaacagcttgctcctgtttccctcactgtgcagcccagggctgggggcagtgaggagcttgcagctctgtgggaaggggaaacaccccctcccctcggcccctcagacgctacccaatgatgccggtttgcagagttggcctgtggaatggctcatgtttgtgcgtgtgtgtgtgtatatttatgggcatgggtgcatgcttggtgtgtatttgtacatgtctgtattgctgtgtccctgtaaatacatgcttgtgtatggatggaagaggccaggcccaggcctggcctcttcctcgggcctgtggccacacctcctgcagctccccaaaatgactgaggcagaaagcccttggggagcctagaaagcaaagctaaaggggatgcagggtctgtctgtctgtctgtctttcagtctgaggaatgagaatcctgacctgagggctgtgcagctgagagcccactacctccccagcccctctcggccccagccgcatcatcccacctgtcccctcccccccacctccagtggggctttctccagatgtcttatggttgggggtttcctgatgggccaggagaggagggcatcttcttgcgacagcactgtctgggttaagtgcccagtgagggcatggtgtggggagctggcctcagaggagccgctggtgggcaagcgtgaagtgggctgaggggctctgagccactttgctcccatctaggggactgccccccatggaactcctttgaagtcacagcagccttcctttctgtttgctcttggggctgagaggtggctcaaacactcggggtccctatggctctgggtcaatctaggccaggctgcaccccatggacagggagtctcagggctcctgatcatgcccaggccctggcctggggcctccctccttggcagctttcccacccccacgcccctggcatcctcagttgctatgggatgcccctccagggcaccagctcagggctaagcgaaggaagataggagcagctcagagctgccaggctctgccttcctcacagacctggtggggcaggtcctgttcacagcagcaggagtgaaggcctggccatcggtggagagggcagctgtcagagggctgggggccagggcacaggattgaagagtttcacatatcatcacagcatacactgggaatttggtgggggcagaagaacccagggccactccctcaatatgaagggaaaccaagctgaatgtgaccaccggcacactgctgccatgtcccatgtccacctttctccccgggaataactggccctgagacccctagacccaaggaggcctgtccatgccaagcatccgggaagcatggctggccttatccacccatgggtcacgtcggttcccaggggcagcatgggagatctttgggggcaacagggagagtctgggtggggagacgggacttgtccaagcagaaggcaggaccctgggaaatgcataatgtaaggacatcaataatagtattattttttttgtaagggaaaatcaatatgtacattctgaaatcattttctctgtaaatggttggatttcatttcacccttaaagggatgcttaaaggagaagataatattaataataaaaacagctacaaagtctgaa

SEQ ID NO: 17134 - DNA, 552 bp, Homo sapiens
gtatttggtcgtccagcgggaaacccaaatggaaggaaagaaaaaaaaaaaaaaccatgcatttatagaacctctgccaatggccaggctccatgcagaatgctttgacaccgtggctcagccaggtctcccacaggactgcaaaacagagggtgacatctttcttttagatcggagaagactgaggaccagagaagctaagtaacttgccaaagggcacacagcaaatggagtcttgctcttgtcacccaggttctggagtgcaatggcgtgatcatggctcactgcaacttccgccccctgggttcaagatgaagatgagacgctacaagctctttctcatgttctgtatggccggcctgtgcctcatctccttcctgcacttcttcaagaccctgtcctatgtcaccttcccccgagaactggcctccctcagccctaacctggtgtccagctttttctggaacaatgccccggtcacgccccaggccagccccgagccaggaggccctgacctgctgcgtaccccactctactcccactcgcccctgc

SEQ ID NO: 17135 - DNA, 569 bp, Homo sapiens
acacctgggctcagcctctagggaggaaactgctgccatagagccttgaaagccaggcagaggggactagacactgtgcctcaaggatgaagatgagacgctacaagctctttctcatgttctgtatggccggcctgtgcctcatctccttcctgcacttcttcaagaccctgtcctatgtcaccttcccccgagaactggcctccctcagccctaacctggtgtccagctttttctggaacaatgccccggtcacgccccaggccagccccgagccaggaggccctgacctgctgcgtaccccactctactcccactcgcccctgctgcagccgctgccgcccagcaaggcggccgaggagctccaccgggtggacttggtgctgcccgaggacaccaccgagtatttcgtgcgcaccaaggccggcggcgtctgcttcaaacccggcaccaagatgctggagaggccgcccccgggacggccggaggagaagcctgagggggccaacggctcctcggcccggcggccaccccggtacctcctgagcgcccgggagcgcacggggggc

SEQ ID NO: 17136 - DNA, 2631 bp, Homo sapiens
tctctgatcgggcccaccccctggatctagcaccgcctcttccgcgttctcggaggagcgatctgcaggtaggggtgcgcgcgaccgctccccggcgggagccagcgaaggtttccatgtcagaggccaatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcagggggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattct

SEQ ID NO: 17137 - DNA, 2421 bp, Homo sapiens
cagaaacaactctccaagttccatttccaaggaaagtcttaaccatttgtcccttctggcgtaccctctttcattgaaatccatgcagaatataccagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattct

SEQ ID NO: 17138 - DNA, 2618 bp, Homo sapiens
gcgatctgcaggtaggggtgcgcgcgaccgctccccggcgggagccagcgaaggtttccatgtcagaggccaatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattct

SEQ ID NO: 17139 - DNA, 2719 bp, Homo sapiens
gcgaccgctccccggcgggagccagcgaaggtttccatgtcagaggccaatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaagacaaagtctctctctgtcacctaggctggagtgctatggcgccatcagggctcactgcagccccaacctccctgggctccagtgatcctcccacctcagcctcccaagtagctgggactacaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattcta

SEQ ID NO: 17140 - DNA, 1270 bp, Homo sapiens
ttccgcgttctcggaggagcgatctgcaggtttccatgtcagaggccaatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcagggggaacagcagcacaatggacctgacgctcttcgcagctgaggccatcgcccttaaccgccagctatctcagcacgaagagaacgaactagcagaggagccaga

SEQ ID NO: 17141 - DNA, 738 bp, Homo sapiens
tctctgatcgggcccaccccctggatctagcaccgcctcttccgcgttctcggaggagcgatctgcaggtttccatgtcagaggccaatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtga

SEQ ID NO: 17142 - DNA, 530 bp, Homo sapiens
ttccgcgttctcggaggagcgatctgcaggtaggggtgcgcgcgaccgctccccggcgggagccagcgaaggtaaaagcgagacctgcgaggtttccatgtcagaggccaatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtca

SEQ ID NO: 17143 - DNA, 567 bp, Homo sapiens
gcaggagggcagccgcggccggcaggacaggcagacggacaggctgacaggagagagaacaggcactgcgggacctgcaggagaaaggcgatcctgtggctgggaatgtgaccccacggccagaagaggacccgtttccatgtcagaggccaatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcag

SEQ ID NO: 17144 - DNA, 1127 bp, Homo sapiens
gcaggagggcagccgcggccggcaggacaggcagacggacaggctgacaggagagagaacaggcactgcgggacctgcaggagaaaggcgatcctgtggctgggaatgtgaccccacggccagaagaggacccgtttccatgtcagaggccaatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggtacttaccgttgagtatgtgtgtggacttctgattaagacccagggtggtgatcatccatcatgaatcccagagacttccaaaacgagtcaagctaataaaaaggatgaaggacttaaaaactgcccttgatttgggagaagggaggccggagggaaggatgataattagcattttgcagagcttagaatgtcacctgtgtgggtattttataaatgccttttcattataataggagtcatatatagatacatttagtcatcgatttatcaatcccgttttgacatgttcactgtttaactacattaattatggggtggaagctctcaaatacattgcgaagtctagaaaggctaaaacagaggagaggagggtcctattgtttgggacacagacccaggataaaggggaagcctgagaatgtgccatccttcagatggaaagatgccatcacccacacacataatcactg

SEQ ID NO: 17145 - DNA, 3774 bp, Homo sapiens
cggctcctctcagcggcggtggcccaggtagaggggtccgcgctggcggcggcggcggcgctgttccccgcgcggtccgcggagcggggtccgggctgcgcgacgtggggcggcggcggcactgcggccccggcccaagcccgaccccgggtcccctcctcggccgccccccgcccggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggttttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttttttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtc

SEQ ID NO: 17146 - DNA, 1747 bp, Homo sapiens
cggctcctctcagcggcggtggcccaggtagaggggtccgcgctggcggcggcggcggcgctgttccccgcgcggtccgcggagcggggtccgggctgcgcgacgtggggcggcggcggcactgcggccccggcccaagcccgaccccgggtcccctcctcggccgccccccgcccggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtc

SEQ ID NO: 17147 - DNA, 1503 bp, Homo sapiens
agatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggttttttttttcctgtttccacccctccccgttat

SEQ ID NO: 17148 - DNA, 1425 bp, Homo sapiens
aggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattccca

SEQ ID NO: 17149 - DNA, 2946 bp, Homo sapiens
cgggcaaccgcctcgcccgaagccctccctcgttactgtccgcataccccggcggcgccgccgcgggaagcggctccccctcctcttcctccgcgtcctcttccctctttcccccgccggggccgcttgttgcaccgccccgcggcctgcgggagccgctcgccccggccttgtgctcgcgtccgcacccctttcctgtcgccccccggggcccgcaccacagcccggccggcgagaccccggccagaccccgctgcccgcacaaaatgtcggcccggacgccattgccgacggtgaacgagcgggacacggaaaatcatacatctgtggatggatatactgaaccacacatccagcctaccaagtcgagtagcagacagaacatcccccggtgtagaaactccattacgtcagcaacagatgaacagcctcacattggaaattaccgtttacaaaaaacaatagggaagggaaattttgccaaagtcaaattggcaagacacgttctaactggtagagaggttgctgtgaaaataatagacaaaactcagctaaatcctaccagtctacaaaagttatttcgagaagtacgaataatgaagatactgaatcatcctaatatagtaaaattgtttgaagttattgaaacagagaagactctctatttagtcatggaatacgcgagtgggggtgaagtatttgattacttagttgcccatggaagaatgaaagagaaagaggcccgtgcaaaatttaggcagattgtatctgctgtacagtattgtcatcaaaagtacattgttcaccgtgatcttaaggctgaaaaccttctccttgatggtgatatgaatattaaaattgctgactttggttttagtaatgaatttacagttgggaacaaattggacacattttgtggaagcccaccctatgctgctcccgagcttttccaaggaaagaagtatgatgggcctgaagtggatgtgtggagtctgggcgtcattctctatacattagtcagtggctccttgcctttcgatggccagaatttaaaggaactgcgagagcgagttttacgagggaagtaccgtattcccttctatatgtccacagactgtgaaaatcttctgaagaaattattagtcctgaatccaataaagagaggcagcttggaacaaataatgaaagatcgatggatgaatgttggtcatgaagaggaagaactaaagccatatactgagcctgatccggatttcaatgacacaaaaagaatagacattatggtcaccatgggctttgcacgagatgaaataaatgatgccttaataaatcagaagtatgatgaagttatggctacttatattcttctaggtagaaaaccacctgaatttgaaggtggtgaatcgttatccagtggaaacttgtgtcagaggtcccggcccagtagtgacttaaacaacagcactcttcagtcccctgctcacctgaaggtccagagaagtatctcagcaaatcagaagcagcggcgtttcagtgatcatgctggtccatccattcctcctgctgtatcatataccaaaagacctcaggctaacagtgtggaaagtgaacagaaagaggagtgggacaaagatgtggctcgaaaacttggcagcacaacagttggatcaaaaagcgagatgactgcaagccctcttgtagggccagagaggaaaaaatcttcaactattccaagtaacaatgtgtattctggaggtagcatggcaagaaggaatacatatgtctgtgaaaggaccacagatcgatacgtagcattgcagaatggaaaagacagcagccttacggagatgtctgtgagtagcatatcttctgcaggctcttctgtggcctctgctgtcccctcagcacgaccccgccaccagaagtccatgtccacttctggtcatcctattaaagtcacactgccaaccattaaagacggctctgaagcttaccggcctggtacaacccagagagtgcctgctgcttccccatctgctcacagtattagtactgcgactccagaccggacccgttttccccgagggagctcaagccgaagcactttccatggtgaacagctccgggagcgacgcagcgttgcttataatgggccacctgcttcaccatcccatgaaacgggtgcatttgcacatgccagaaggggaacgtcaactggtataataagcaaaatcacatccaaatttgttcgcagggatccaagtgaaggcgaagccagtggcagaaccgacacctcaagaagtacatcaggggaaccaaaagaaagagacaaggaagagggtaaagattctaagccgcgttctttgcggttcacatggagtatgaagaccactagttcaatggaccctaatgacatgatgagagaaatccgaaaagtgttagatgcaaataactgtgattatgagcaaaaagagagatttttgcttttctgtgtccatggagacgctagacaggatagcctcgtgcagtgggagatggaagtctgcaagttgccacgactgtcacttaatggggttcgcttcaagcgaatatctgggacatctattgcctttaagaacattgcatcaaaaatagcaaatgagcttaagctgtaaagaagtccaaatttacaggttcagggaagatacatacatatatgaggtacagtttttgaatgtactggtaatgcctaatgtggtctgcctgtgaatctccccatgtagaatttgcccttaatgcaataaggttatacatagttatgaactgtaaaattaaagtcagtatgaactataataaatatctgtagcttaaaaagtaggttcacatgtacaggtaagtatattgtgtatttctgttcattttctgttcatagagttgtataataaaacatgattgcttaaaaacttg

SEQ ID NO: 17150 - DNA, 5169 bp, Homo sapiens
ggcgcggcggcggcggtggctgtgaccgcgcggaccgagccgagacattcgcgccgggggatcgggcgccgccgccgctgggccccgggcgcgtggatgcggctgggtcgggcggcgccgtacacctgaggcggagaacggggcgcggcgcgggtgacgctgtcagggccgcggttcctgacgcccaggcgctcgccaggacgagccaggcagtgatttgaggcaccggcttcaccttcacccatggtccggagagcctagcggggctcgccaccgcctcccggctccccttccacgcctcatcctgccagcctcgccgccccgccagcgccgggcaaccgcctcgcccgaagccctccctcgttactgtccgcataccccggcggcgccgccgcgggaagcggctccccctcctcttcctccgcgtcctcttccctctttcccccgccggggccgcttgttgcaccgccccgcggcctgcgggagccgctcgccccggccttgtgctcgcgtccgcacccctttcctgtcgccccccggggcccgcaccacagcccggccggcgagaccccggccagaccccgctgcccgcacaaaatgtcggcccggacgccattgccgacggtgaacgagcgggacacggaaaatcatacatctgtggatggatatactgaaccacacatccagcctaccaagtcgagtagcagacagaacatcccccggtgtagaaactccattacgtcagcaacagatgaacagcctcacattggaaattaccgtttacaaaaaacaatagggaagggaaattttgccaaagtcaaattggcaagacacgttctaactggtagagaggttgctgtgaaaataatagacaaaactcagctaaatcctaccagtctacaaaagttatttcgagaagtacgaataatgaagatactgaatcatcctaatataggtgaagtatttgattacttagttgcccatggaagaatgaaagagaaagaggcccgtgcaaaatttaggcagattgtatctgctgtacagtattgtcatcaaaagtacattgttcaccgtgatcttaaggctgaaaaccttctccttgatggtgatatgaatattaaaattgctgactttggttttagtaatgaatttacagttgggaacaaattggacacattttgtggaagcccaccctatgctgctcccgagcttttccaaggaaagaagtatgatgggcctgaagtggatgtgtggagtctgggcgtcattctctatacattagtcagtggctccttgcctttcgatggccagaatttaaaggaactgcgagagcgagttttacgagggaagtaccgtattcccttctatatgtccacagactgtgaaaatcttctgaagaaattattagtcctgaatccaataaagagaggcagcttggaacaaataatgaaagatcgatggatgaatgttggtcatgaagaggaagaactaaagccatatactgagcctgatccggatttcaatgacacaaaaagaatagacattatggtcaccatgggctttgcacgagatgaaataaatgatgccttaataaatcagaagtatgatgaagttatggctacttatattcttctaggtagaaaaccacctgaatttgaaggtggtgaatcgttatccagtggaaacttgtgtcagaggtcccggcccagtagtgacttaaacaacagcactcttcagtcccctgctcacctgaaggtccagagaagtatctcagcaaatcagaagcagcggcgtttcagtgatcatgctggtccatccattcctcctgctgtatcatataccaaaagacctcaggctaacagtgtggaaagtgaacagaaagaggagtgggacaaagatgtggctcgaaaacttggcagcacaacagttggatcaaaaagcgagatgactgcaagccctcttgtagggccagagaggaaaaaatcttcaactattccaagtaacaatgtgtattctggaggtagcatggcaagaaggaatacatatgtctgtgaaaggaccacagatcgatacgtagcattgcagaatggaaaagacagcagccttacggagatgtctgtgagtagcatatcttctgcaggctcttctgtggcctctgctgtcccctcagcacgaccccgccaccagaagtccatgtccacttctggtcatcctattaaagtcacactgccaaccattaaagacggctctgaagcttaccggcctggtacaacccagagagtgcctgctgcttccccatctgctcacagtattagtactgcgactccagaccggacccgttttccccgagggagctcaagccgaagcactttccatggtgaacagctccgggagcgacgcagcgttgcttataatgggccacctgcttcaccatcccatgaaacgggtgcatttgcacatgccagaaggggaacgtcaactggtataataagcaaaatcacatccaaatttgttcgcagaagtacatcaggggaaccaaaagaaagagacaaggaagagggtaaagattctaagccgcgttctttgcggttcacatggagtatgaagaccactagttcaatggaccctaatgacatgatgagagaaatccgaaaagtgttagatgcaaataactgtgattatgagcaaaaagagagatttttgcttttctgtgtccatggagacgctagacaggatagcctcgtgcagtgggagatggaagtctgcaagttgccacgactgtcacttaatggggttcgcttcaagcgaatatctgggacatctattgcctttaagaacattgcatcaaaaatagcaaatgagcttaagctgtaaagaagtccaaatttacaggttcagggaagatacatacatatatgaggtacagtttttgaatgtactggtaatgcctaatgtggtctgcctgtgaatctccccatgtagaatttgcccttaatgcaataaggttatacatagttatgaactgtaaaattaaagtcagtatgaactataataaatatctgtagcttaaaaagtaggttcacatgtacaggtaagtatattgtgtatttctgttcattttctgttcatagagttgtataataaaacatgattgcttaaaaacttgtatagttgtctagatttctgcacctgaatgtatgtttgatgctttgatttgaaaatgttcttccctgttatttacattctggtgggtttttaaaattcttacctccatcatgcaattttgaaaattgtgtccagaattaaaagtgcatagaaatagcctttacaattgtagcatggacctttaaaaattgttttaaaatcttatttaaatttaaaccagaagctgaaaaatagatcagctttattatacacaaaattattactgcttatctttgctcttttccttgttatcccgcaaggtttagttgagaagatacaaaatgtttacagtgttggcacttagagtttttaaattcaagtacatgaaattcagtaatagcattgccttgagctaactaggaagtaccgggaaaaaagttaaatctacatcaagtttcttttgaactttgaagtgttttctgacccactgctaactgtagcaacaaaatttaaaagaaaaaaaacatactttatctggctattataacataaactgtcacgtaggtttgctgccttcagaataccgcaatttaattgcgggaatataataatattgggactgtttcacagcacaaactcatctttacagtgttgatcaatgcatcagttaagaaataatgccacctcaggaattaactggcattgggaacatttgcctcattctcctgctatcctcttcattcacccctgccactgtaatatctataagtacttaagagacttgtgagcaaaacatactatttataacagtatatgattgatttatgcttatgtggttgttcagtttgttcccatgtaactcgtttgttttaaatattttgccagatttcttgtatttattccacatcattatgcctataatgtgccgctttgtgattgggcatttgcctacttttctttcataattagtgatatatgcgatgtaaaaccactagtaaaggtacattttaatacttgttattttatactgaattagccttggaggttgactgtgcaatgttatttactgttgtaattactgtaataccaacatatgggccccatctgcacactcctgaaaaacagaaagtgtattcaaattttatcagtttaaagaaaataaagctgtgataaatactgtaattccaacctacattagaaggtctaagtgtaggtgatgtgccattccataatggcttccagactagggtgaattttatgttctgtactgtactgtgatgtagctttcttctgtaacagttatgttttaaaattaagtgagttttttttttgccttagcaaagggtggtgtttgaaaaaaaaaatgtgtagcccctttttaacctagtgttcattcaaaaaaaaattgatgcaaatctttattcactttcactggtgcacactgaaattttacttgaacagttctcataataaagcacttgtcttttgctctttatcagaatgtgaattacctgttttctggtacaaaagtattctgtatgaggagtttattgtatgtgttctaaatttagttggcaaagggtgaagctgtgaaggttttcaagattattgaaactatgaaggtttcttgtcattatgacaagaaagtttaatctttttataggaattcctgtcactgaaatacgtttttaaaaaaatagactcatgtgttttccacggtagaaactgatatttttttacattttctcactgtggccaactcttctgtgtttgtagaaaggaatttgacttcaatatcttttatgaactaaaaatgaaatcttgatactcactttagatttttcattttatgtgttcatgacaacataaatatttttcaaagatttagaggaattttgcaatgtgtttgcataaataaataccagtttatgttcaccggctatgtgataccaggatttccttggcttctgttgaaatattatttgatatgacatcccttatattaaattaattattttgtagaaa

SEQ ID NO: 17151 - DNA, 5230 bp, Homo sapiens
ggcgcggcggcggcggtggctgtgaccgcgcggaccgagccgagacattcgcgccgggggatcgggcgccgccgccgctgggccccgggcgcgtggatgcggctgggtcgggcggcgccgtacacctgaggcggagaacggggcgcggcgcgggtgacgctgtcagggccgcggttcctgacgcccaggcgctcgccaggacgagccaggcagtgatttgaggcaccggcttcaccttcacccatggtccggagagcctagcggggctcgccaccgcctcccggctccccttccacgcctcatcctgccagcctcgccgccccgccagcgccgggcaaccgcctcgcccgaagccctccctcgttactgtccgcataccccggcggcgccgccgcgggaagcggctccccctcctcttcctccgcgtcctcttccctctttcccccgccggggccgcttgttgcaccgccccgcggcctgcgggagccgctcgccccggccttgtgctcgcgtccgcacccctttcctgtcgccccccggggcccgcaccacagcccggccggcgagaccccggccagaccccgctgcccgcacaaaatgtcggcccggacgccattgccgacggtgaacgagcgggacacggaaaatcatacatctgtggatggatatactgaaccacacatccagcctaccaagtcgagtagcagacagaacatcccccggtgtagaaactccattacgtcagcaacagatgaacagcctcacattggaaattaccgtttacaaaaaacaatagggaagggaaattttgccaaagtcaaattggcaagacacgttctaactggtagagaggttgctgtgaaaataatagacaaaactcagctaaatcctaccagtctacaaaagttatttcgagaagtacgaataatgaagatactgaatcatcctaatatagtaaaattgtttgaagttattgaaacagagaagactctctatttagtcatggaatacgcgagtgggggtgaagtatttgattacttagttgcccatggaagaatgaaagagaaagaggcccgtgcaaaatttaggcagattgtatctgctgtacagtattgtcatcaaaagtacattgttcaccgtgatcttaaggctgaaaaccttctccttgatggtgatatgaatattaaaattgctgactttggttttagtaatgaatttacagttgggaacaaattggacacattttgtggaagcccaccctatgctgctcccgagcttttccaaggaaagaagtatgatgggcctgaagtggatgtgtggagtctgggcgtcattctctatacattagtcagtggctccttgcctttcgatggccagaatttaaaggaactgcgagagcgagttttacgagggaagtaccgtattcccttctatatgtccacagactgtgaaaatcttctgaagaaattattagtcctgaatccaataaagagaggcagcttggaacaaataatgaaagatcgatggatgaatgttggtcatgaagaggaagaactaaagccatatactgagcctgatccggatttcaatgacacaaaaagaatagacattatggtcaccatgggctttgcacgagatgaaataaatgatgccttaataaatcagaagtatgatgaagttatggctacttatattcttctaggtagaaaaccacctgaatttgaaggtggtgaatcgttatccagtggaaacttgtgtcagaggtcccggcccagtagtgacttaaacaacagcactcttcagtcccctgctcacctgaaggtccagagaagtatctcagcaaatcagaagcagcggcgtttcagtgatcatgctggtccatccattcctcctgctgtatcatataccaaaagacctcaggctaacagtgtggaaagtgaacagaaagaggagtgggacaaagatgtggctcgaaaacttggcagcacaacagttggatcaaaaagcgagatgactgcaagccctcttgtagggccagagaggaaaaaatcttcaactattccaagtaacaatgtgtattctggaggtagcatggcaagaaggaatacatatgtctgtgaaaggaccacagatcgatacgtagcattgcagaatggaaaagacagcagccttacggagatgtctgtgagtagcatatcttctgcaggctcttctgtggcctctgctgtcccctcagcacgaccccgccaccagaagtccatgtccacttctggtcatcctattaaagtcacactgccaaccattaaagacggctctgaagcttaccggcctggtacaacccagagagtgcctgctgcttccccatctgctcacagtattagtactgcgactccagaccggacccgttttccccgagggagctcaagccgaagcactttccatggtgaacagctccgggagcgacgcagcgttgcttataatgggccacctgcttcaccatcccatgaaacgggtgcatttgcacatgccagaaggggaacgtcaactggtataataagcaaaatcacatccaaatttgttcgcagaagtacatcaggggaaccaaaagaaagagacaaggaagagggtaaagattctaagccgcgttctttgcggttcacatggagtatgaagaccactagttcaatggaccctaatgacatgatgagagaaatccgaaaagtgttagatgcaaataactgtgattatgagcaaaaagagagatttttgcttttctgtgtccatggagacgctagacaggatagcctcgtgcagtgggagatggaagtctgcaagttgccacgactgtcacttaatggggttcgcttcaagcgaatatctgggacatctattgcctttaagaacattgcatcaaaaatagcaaatgagcttaagctgtaaagaagtccaaatttacaggttcagggaagatacatacatatatgaggtacagtttttgaatgtactggtaatgcctaatgtggtctgcctgtgaatctccccatgtagaatttgcccttaatgcaataaggttatacatagttatgaactgtaaaattaaagtcagtatgaactataataaatatctgtagcttaaaaagtaggttcacatgtacaggtaagtatattgtgtatttctgttcattttctgttcatagagttgtataataaaacatgattgcttaaaaacttgtatagttgtctagatttctgcacctgaatgtatgtttgatgctttgatttgaaaatgttcttccctgttatttacattctggtgggtttttaaaattcttacctccatcatgcaattttgaaaattgtgtccagaattaaaagtgcatagaaatagcctttacaattgtagcatggacctttaaaaattgttttaaaatcttatttaaatttaaaccagaagctgaaaaatagatcagctttattatacacaaaattattactgcttatctttgctcttttccttgttatcccgcaaggtttagttgagaagatacaaaatgtttacagtgttggcacttagagtttttaaattcaagtacatgaaattcagtaatagcattgccttgagctaactaggaagtaccgggaaaaaagttaaatctacatcaagtttcttttgaactttgaagtgttttctgacccactgctaactgtagcaacaaaatttaaaagaaaaaaaacatactttatctggctattataacataaactgtcacgtaggtttgctgccttcagaataccgcaatttaattgcgggaatataataatattgggactgtttcacagcacaaactcatctttacagtgttgatcaatgcatcagttaagaaataatgccacctcaggaattaactggcattgggaacatttgcctcattctcctgctatcctcttcattcacccctgccactgtaatatctataagtacttaagagacttgtgagcaaaacatactatttataacagtatatgattgatttatgcttatgtggttgttcagtttgttcccatgtaactcgtttgttttaaatattttgccagatttcttgtatttattccacatcattatgcctataatgtgccgctttgtgattgggcatttgcctacttttctttcataattagtgatatatgcgatgtaaaaccactagtaaaggtacattttaatacttgttattttatactgaattagccttggaggttgactgtgcaatgttatttactgttgtaattactgtaataccaacatatgggccccatctgcacactcctgaaaaacagaaagtgtattcaaattttatcagtttaaagaaaataaagctgtgataaatactgtaattccaacctacattagaaggtctaagtgtaggtgatgtgccattccataatggcttccagactagggtgaattttatgttctgtactgtactgtgatgtagctttcttctgtaacagttatgttttaaaattaagtgagttttttttttgccttagcaaagggtggtgtttgaaaaaaaaaatgtgtagcccctttttaacctagtgttcattcaaaaaaaaattgatgcaaatctttattcactttcactggtgcacactgaaattttacttgaacagttctcataataaagcacttgtcttttgctctttatcagaatgtgaattacctgttttctggtacaaaagtattctgtatgaggagtttattgtatgtgttctaaatttagttggcaaagggtgaagctgtgaaggttttcaagattattgaaactatgaaggtttcttgtcattatgacaagaaagtttaatctttttataggaattcctgtcactgaaatacgtttttaaaaaaatagactcatgtgttttccacggtagaaactgatatttttttacattttctcactgtggccaactcttctgtgtttgtagaaaggaatttgacttcaatatcttttatgaactaaaaatgaaatcttgatactcactttagatttttcattttatgtgttcatgacaacataaatatttttcaaagatttagaggaattttgcaatgtgtttgcataaataaataccagtttatgttcaccggctatgtgataccaggatttccttggcttctgttgaaatattatttgatatgacatcccttatattaaattaattattttgt

SEQ ID NO: 17152 - DNA, 4701 bp, Homo sapiens
aaacagagccgaagcttcgtcttcggaatcgaggaggagagcgcgtccccggggtttaccttcttcggctgtttccggaattcacccgtagtctgtggccgggaggagaaggcgcgccccacctcccgtttctagccgcttcggatgtttccggctgctgccggcgaaaagagccgagggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggcagctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttattttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctg

SEQ ID NO: 17153 - DNA, 2903 bp, Homo sapiens
gaaaagagccgagggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaa

SEQ ID NO: 17154 - DNA, 3004 bp, Homo sapiens
gaattcacccgtagtctgtggccgggaggagaaggcgcgccccacctcccgtttctagccgcttcggatgtttccggctgctgccggcgaaaagagccgagggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggcagctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcagaaatctgtctttcaggtttgccagaagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaag

SEQ ID NO: 17155 - DNA, 4683 bp, Homo sapiens
aaacagagccgaagcttcgtcttcggaatcgaggaggagagcgcgtccccggggtttaccttcttcggctgtttccggaattcacccgtagtctgtggccgggaggagaaggcgcgccccacctcccgtttctagccgcttcggatgtttccggctgctgccggcgaaaagagccgagggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggcagctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcagaaatctgtctttcaggtttgccagaagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttattttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctg

SEQ ID NO: 17156 - DNA, 4536 bp, Homo sapiens
aaacagagccgaagcttcgtcttcggaatcgaggaggagagcgcgtccccggggtttaccttcttcggctgtttccggaattcacccgtagtctgtggccgggaggagaaggcgcgccccacctcccgtttctagccgcttcggatgtttccggctgctgccggcgaaaagagccgagggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttattttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctg

SEQ ID NO: 17157 - DNA, 4728 bp, Homo sapiens
aaacagagccgaagcttcgtcttcggaatcgaggaggagagcgcgtccccggggtttaccttcttcggctgtttccggaattcacccgtagtctgtggccgggaggagaaggcgcgccccacctcccgtttctagccgcttcggatgtttccggctgctgccggcgaaaagagccgagggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggcagctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcagaaatctgtctttcaggtttgccagaaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttattttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctg

SEQ ID NO: 17158 - DNA, 2112 bp, Homo sapiens
cccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcggg

SEQ ID NO: 17159 - DNA, 4566 bp, Homo sapiens
aaacagagccgaagcttcgtcttcggaatcgaggaggagagcgcgtccccggggtttaccttcttcggctgtttccggaattcacccgtagtctgtggccgggaggagaaggcgcgccccacctcccgtttctagccgcttcggatgtttccggctgctgccggcgaaaagagccgagggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggcagctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcagaaatctgtctttcaggtttgccagaaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttattttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctg

SEQ ID NO: 17160 - DNA, 2891 bp, Homo sapiens
gcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccaggcaagtcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattacc

SEQ ID NO: 17161 - DNA, 1176 bp, Homo sapiens
gttgggagcagcaggtccggcggcggctgcctgtgtgccgggcgcggagcagtgccgctgagggcaggggaggagcgaggcaggcggccggctgcggcggcagagagtaggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccc

SEQ ID NO: 17162 - DNA, 2924 bp, Homo sapiens
gaattcacccgtagtctgtggccgggaggagaaggcgcgccccacctcccgtttctagccgcttcggatgtttccggctgctgccggcgaaaagagccgagggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaagg

SEQ ID NO: 17163 - DNA, 1022 bp, Homo sapiens
atggaagtcgctggtagtccttttccctttctccagtcggtggcttgcctccttaccctggctcacatccctgctgtgggaaacatcttacagcatagaagaaggggtgcagggcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccc

SEQ ID NO: 17164 - DNA, 558 bp, Homo sapiens
agtttctcttcatggattacctgctcgcggcaggcaggcaggcagctccccacctggaagcctgcagactcgccgagctgagagaatcatgctgcagatctcatgcttcttttttactttgtgttggcaaaaaccccaggagaagatgggagattctgggaggagatgattatgctggcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatgg

SEQ ID NO: 17165 - DNA, 595 bp, Homo sapiens
gatcattgtcattattgttccagttgaacaacacagtgaattttatctgagcaccacacaactctagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagacttt

SEQ ID NO: 17166 - DNA, 557 bp, Homo sapiens
agtatcttaagtaggtgtggtaatgactacagagaagtgctttttcaggatgagaagatgagggagaaaatttacaccattgctggattgtgttaagaactcggagaggaaaccacagggaggatgcactgctgaggaaatcgtctggcttcctggagtggggaccagagccagagagccaagccctcctggctttgctgagttctgtccttgcccctgacaccaacgtgtctgcctgcgttgttgctcctggttacagtgggctcagtcttgcctcttttttgatgggtgggcagaggaacactagtgttgggaatattgtccagcgttggagagatcatgtggtctgtcagaaggctggagttatttatagtgggagaaaagcccaggagcatggcacgggaagaactgatttcacaccagctcagcgcctgatgatgcccaccttgggacaccttgactccaagcccagcagtaagtccaacatgattcggggccgcaactcagccacctctgctgatgagcagccccacattggaaactaccggctcctcaag

SEQ ID NO: 17167 - DNA, 2862 bp, Homo sapiens
cttcctgccctattcccctcctgccccttccctcccaccttgcttctggtgtgctgtcctggaattgcacgcgcttcctgaccaccaggctctggcccttgagaagccagcggggctttgtccctgttgctctccttgccaaacccagtctctctgctagtggtggtttcggttgcgacaccgtccaggttcccaggcaggaaccgctcggcctggctgcttagctacttttcactgaggaggtggtggaaggtgtcgcctgctctggctgagtaagggtggctggctgagccggcagcccccgccctaggcctggctcttcccggcctctgtactttgccctcgctgcctgacaggttctgctgtgggctctgctgaatggaagtcgctggtagtccttttccctttctccagtcggcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgt

SEQ ID NO: 17168 - DNA, 2911 bp, Homo sapiens
gacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagaggttaggccgagcagtgatctcaacaacagtactggccagtctcctcaccacaaagtgcagagaagtgttttttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggtgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcag

SEQ ID NO: 17169 - DNA, 3283 bp, Homo sapiens
gctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgttttttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggtgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 17170 - DNA, 3657 bp, Homo sapiens
gtcacttccggcagccggaggcagcagaggaagccgaggggcggccatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgttttttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcctgacagaaatgttcgcttacgcagctagccctgcctcagtttgtacatctacctgtcggctgagacatcagaagtcgatgtccatgtcagcctctgggcaccccaagatgatgttacctccaatagacagtgaaggagataacttcaaggctatcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggaggcttccaactgaatatgagaggaacgggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggtgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagt

SEQ ID NO: 17171 - DNA, 2969 bp, Homo sapiens
gcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagggttgtcaagctggacagactattaaagttcaagtctcctttgatttgcttagtctgatgtttacatttattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgttttttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagc

SEQ ID NO: 17172 - DNA, 3371 bp, Homo sapiens
caggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgttttttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagaaacatgtcattcaggtttatcaaaaggcttccaactgaatatgagaggaacgggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggtgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcag

SEQ ID NO: 17173 - DNA, 2643 bp, Homo sapiens
ggaagccgaggggcggccatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgttttttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagaaacatgtcattcaggtttatcaaaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaag

SEQ ID NO: 17174 - DNA, 2298 bp, Homo sapiens
gttttgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgttttttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggaggcttccaactgaatatgagaggaacgggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgta

SEQ ID NO: 17175 - DNA, 1571 bp, Homo sapiens
aagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagaggttaggccgagcagtgatctcaacaacagtactggccagtctcctcaccacaaagtgcagagaagtgttttttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagaaacatgtcattcaggtttatcaaaaggcttccaactgaatatgagaggaacgggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactg

SEQ ID NO: 17176 - DNA, 4837 bp, Homo sapiens
agaagatgtcttcgcggacggtgctggccccgggcaacgatcggaactcggacacgcatggcaccttgggcagtggccgctcctcggacaaaggcccgtcctggtccagccgctcactgggtgcccgttgccggaactccatcgcctcctgtcccgaggagcagccccacgtgggcaactaccgcctgctgaggaccattgggaagggcaactttgccaaagtcaagctggctcggcacatcctcactggtcgggaggttgccatcaagattatcgacaaaacccagctgaatcccagcagcctgcagaagctgttccgagaagtccgcatcatgaagggcctaaaccaccccaacatcgtgaagctctttgaggtgattgagactgagaagacgctgtacctggtgatggagtacgcaagtgctggagaagtgtttgactacctcgtgtcgcatggccgcatgaaggagaaggaagctcgagccaagttccgacagattgtttcggctgtgcactattgtcaccagaaaaatattgtacacagggacctgaaggctgagaacctcttgctggatgccgaggccaacatcaagattgctgactttggcttcagcaacgagttcacgctgggatcgaagctggacacgttctgcgggagccccccatatgccgccccggagctgtttcagggcaagaagtacgacgggccggaggtggacatctggagcctgggagtcatcctgtacaccctcgtcagcggctccctgcccttcgacgggcacaacctcaaggagctgcgggagcgagtactcagagggaagtaccgggtccctttctacatgtcaacagactgtgagagcatcctgcggagatttttggtgctgaacccagctaaacgctgtactctcgagcaaatcatgaaagacaaatggatcaacatcggctatgagggtgaggagttgaagccatacacagagcccgaggaggacttcggggacaccaagagaattgaggtgatggtgggtatgggctacacacgggaagaaatcaaagagtccttgaccagccagaagtacaacgaagtgaccgccacctacctcctgctgggcaggaagactgaggagggtggggaccggggcgccccagggctggccctggcacgggtgcgggcgcccagcgacaccaccaacggaacaagttccagcaaaggcaccagccacagcaaagggcagcggagttcctcttccacctaccaccgccagcgcaggcatagcgatttctgtggcccatcccctgcacccctgcaccccaaacgcagcccgacgagcacgggggaggcggagctgaaggaggagcggctgccaggccggaaggcgagctgcagcaccgcggggagtgggagtcgagggctgcccccctccagccccatggtcagcagcgcccacaaccccaacaaggcagagatcccagagcggcggaaggacagcacgagcacccccaacaacctccctcctagcatgatgacccgcagaaacacctacgtttgcacagaacgcccgggggctgagcgcccgtcactgttgccaaatgggaaagaaaacagctcaggcaccccacgggtgccccctgcctccccctccagtcacagcctggcacccccatcaggggagcggagccgcctggcacgtggttccaccatccgcagcaccttccatggtggccaggtccgggaccggcgggcagggggtgggggtggtgggggtgtgcagaatgggccccctgcctctcccacactggcccatgaggctgcacccctgcccgccgggcggccccgccccaccaccaacctcttcaccaagctgacctccaaactgacccgaagggtcgcagacgaacctgagagaatcgggggacctgaggtcacaagttgccatctaccttgggatcaaacggaaaccgccccccggctgctccgattcccctggagtgtgaagctgaccagctcgcgccctcctgaggccctgatggcagctctgcgccaggccacagcagccgcccgctgccgctgccgccagccacagccgttcctgctggcctgcctgcacgggggtgcgggcgggcccgagcccctgtcccacttcgaagtggaggtctgccagctgccccggccaggcttgcggggagttctcttccgccgtgtggcgggcaccgccctggccttccgcaccctcgtcacccgcatctccaacgacctcgagctctgagccaccacggtcccagggcccttactcttcctctcccttgtcgccttcacttctacaggaggggaaggggccagggaggggattctccctttatcatcacctcagtttccctgaattatatttgggggcaaagattgtcccctctgctgttctctggggccgctcagcacagaagaaggatgagggggctcagcggggggagctggcaccttcctggagcctccagccagtcctgtcctccctcgccctaccaagagggcacctgaggagactttggggacagggcaggggcagggagggaaactgaggaaatcttccattcctcccaacagctcaaaattaggccttgggcaggggcagggagagctgctgagcctaaagactggagaatctgggggactgggagtgggggtcagagaggcagattccttcccctcccgtcccctcacgctcaaacccccacttcctgccccaggctggcgcggggcactttgtacaaatccttgtaaataccccacaccctcccctctgcaaaggtctcttgaggagctgccgctgtcacctacggtttttaagttattacaccccgaccctcctcctgtcagccccctcacctgcagcctgttgcccaataaatttaagagagtccccccctccccaatgctgaccctaggattttccttccctgccctcacctgcaaatgagttaaagaagaggcgtgggaatccaggcagtggtttttcctttcggagcctcggttttctcatctgcagaatgggagcggtgggggtgggaaggtaaggatggtcgtggaagaaggcaggatggaactcggcctcatccccgaggccccagttcctatatcgggccccccattcatccactcacactcccagccaccatgttacactggactctaagccacttcttactccagtagtaaatttattcaataaacaatcattgacccatgcctactccatgccaggcccagtgctggacacagagacatgaagctctgtctgtgggagacagggattctgacacagacaccggacaaaccattgtcttggggagcccagaagagaaagtgggcagggtggggtcattggggaagatgctctagaggaattaatgctggaatggggtgttgaaggatgagtaggagttagttaggcattgagtttgccctgggcaaaagcccagaagtgggagtatgtggtatatcttcagagaactgggtaatttcagtgtggctgctgtgttgggcatggatggagaatcagcaagagaaatgctgtattaggactaataatccatctacgctgcttaagcaaaaaggtatttgttggtttatgttacttaatagtccaggggcacctggcttcaggtaggtttgatccaggcatcaggccattgcatctattttttcagtgtaagttgaattctagtaatttttatcaagtaagggctcctttcctggtggcacagatgacttcagcagttagaagtttctatccctccagctttctgcagcagaaagaccctcattgtcagtttcccagcaaaagtcccagggcagactctcattggcccaaatgggccatgtgattttctctaaaccaatcactgtgactctagagtggccagactcagagctgcacttagtaggggttcctcaaaggaaggtcaagtgtcatgagcaggagaaaaggcatgggagctggacagattatagtggttgaagtctgtgcagtacagaagggcggagcttattcacacagcacctttggggccaaaatgaataagctggactttctccccatggcactggggaaccatggaagttcagggaacttcagggaagaggcttggtcaattcctgagagcatcctctgtgctggggacacagtggtaatcaagacagccccaacactgccctcatagagctcacagtccaatggaggaggcagatgtgtcctcaggcagcgactgggcagggctggtataggggagtccagaggtgatgcctgcctcagccagggagggcttcctggaggagaaggagccagctagacatggataggagtgcgttttaggcacagcaaatggcacatacaagggccagggagcaagagagaggacaggtcctcaacaaatggcatgtgactttgtaagtgtagaattgctgtgaggtatggggctaggggcgtcagtagggccttgaaggttatggacaggggcctgggctttcttccaagggcactgggggagccatggcaaggttgtaggtagggtagagatgggcgggtttgtgctatgtgcagggtggaagggagggaagttgacaggtcagaagatcaggaaagaggtcggggctggacagatggggagagcgcagatagatttaagagagtcctgtgaggcaaagtgggcaggacctggtaacaggtgtctggactgtggctttggctggctcagaaggtccccactggcgtgtgtggtctatgtagcctctgggtgtggagctgggatcttcaactggggacagtacagtaaagaacatcacagc

SEQ ID NO: 17177 - DNA, 1683 bp, Homo sapiens
cgcctccctccgccgccgcttgggccggctccgcgccccctccgcggcccccgcccgcccgcctgcccgccgcccccatggcgcccggggtccccgctgcacggggccactaggaccctcggcgtcccttcccctcccccgccctgccccctctcccgccgcgcggacccgggcgttctcggcgcccagcttttgagctcgcgtccccaggccggcggggggggaggggaagagaggggaccctgggacccccgccccccccacccggccgcccctgccccccgggacccggagaagatgtcttcgcggacggtgctggccccgggcaacgatcggaactcggacacgcatggcaccttgggcagtggccgctcctcggacaaaggcccgtcctggtccagccgctcactgggtgcccgttgccggaactccatcgcctcctgtcccgaggagcagccccacgtgggcaactaccgcctgctgaggaccattgggaagggcaactttgccaaagtcaagctggctcggcacatcctcactggtcgggaggttgccatcaagattatcgacaaaacccagctgaatcccagcagcctgcagaagctgttccgagaagtccgcatcatgaagggcctaaaccaccccaacatcgtgaagctctttgaggtgattgagactgagaagacgctgtacctggtgatggagtacgcaagtgctggtgagccgcccaccctctccgccctgcccctgtgccacctccccctgccgctgcacctgaccctgaccccgctcggcctctgccctgcaggagaagtgtttgactacctcgtgtcgcatggccgcatgaaggagaaggaagctcgagccaagttccgacagattgtttcggctgtgcactattgtcaccagaaaaatattgtacacagggacctgaaggctgagaacctcttgctggatgccgaggccaacatcaagattgctgactttggcttcagcaacgagttcacgctgggatcgaagctggacacgttctgcgggagccccccatatgccgccccggagctgtttcagggcaagaagtacgacgggccggaggtggacatctggagcctgggagtcatcctgtacaccctcgtcagcggctccctgcccttcgacgggcacaacctcaaggagctgcgggagcgagtactcagagggaagtaccgggtccctttctacatgtcaacagactgtgagagcatcctgcggagatttttggtgctgaacccagctaaacgctgtactctcgagcaaatcatgaaagacaaatggatcaacatcggctatgagggtgaggagttgaagccatacacagagcccgaggaggacttcggggacaccaagagaattgaggtgatggtgggtatgggctacacacgggaagaaatcaaagagtccttgaccagccagaagtacaacgaagtgaccgccacctacctcctgctgggcaggaagactgagcccgacgagcacgggggaggcggagctgaaggaggagcggctgccaggccggaaggcgagctgcagcaccgcggggagtgggagtcgagggctgcccccctccagccccatggtcagcagcgcccacaaccccaacaaggcagagatcccagagcggcggaaggacagcacgagcacccc

SEQ ID NO: 17178 - DNA, 4917 bp, Homo sapiens
agaagatgtcttcgcggacggtgctggccccgggcaacgatcggaactcggacacgcatggcaccttgggcagtggccgctcctcggacaaaggcccgtcctggtccagccgctcactgggtgcccgttgccggaactccatcgcctcctgtcccgaggagcagccccacgtgggcaactaccgcctgctgaggaccattgggaagggcaactttgccaaagtcaagctggctcggcacatcctcactggtcgggaggttgccatcaagattatcgacaaaacccagctgaatcccagcagcctgcagaagctgttccgagaagtccgcatcatgaagggcctaaaccaccccaacatcgtgaagctctttgaggtgattgagactgagaagacgctgtacctggtgatggagtacgcaagtgctggagaagtgtttgactacctcgtgtcgcatggccgcatgaaggagaaggaagctcgagccaagttccgacagattgtttcggctgtgcactattgtcaccagaaaaatattgtacacagggacctgaaggctgagaacctcttgctggatgccgaggccaacatcaagattgctgactttggcttcagcaacgagttcacgctgggatcgaagctggacacgttctgcgggagccccccatatgccgccccggagctgtttcagggcaagaagtacgacgggccggaggtggacatctggagcctgggagtcatcctgtacaccctcgtcagcggctccctgcccttcgacgggcacaacctcaaggagctgcgggagcgagtactcagagggaagtaccgggtccctttctacatgtcaacagactgtgagagcatcctgcggagatttttggtgctgaacccagctaaacgctgtactctcgagcaaatcatgaaagacaaatggatcaacatcggctatgagggtgaggagttgaagccatacacagagcccgaggaggacttcggggacaccaagagaattgaggtgatggtgggtatgggctacacacgggaagaaatcaaagagtccttgaccagccagaagtacaacgaagtgaccgccacctacctcctgctgggcaggaagactgaggagggtggggaccggggcgccccagggctggccctggcacgggtgcgggcgcccagcgacaccaccaacggaacaagttccagcaaaggcaccagccacagcaaagggcagcggagttcctcttccacctaccaccgccagcgcaggcatagcgatttctgtggcccatcccctgcacccctgcaccccaaacgcagcccgacgagcacgggggaggcggagctgaaggaggagcggctgccaggccggaaggcgagctgcagcaccgcggggagtgggagtcgagggctgcccccctccagccccatggtcagcagcgcccacaaccccaacaaggcagagatcccagagcggcggaaggacagcacgagcacccccaacaacctccctcctagcatgatgacccgcagaaacacctacgtttgcacagaacgcccgggggctgagcgcccgtcactgttgccaaatgggaaagaaaacagctcaggcaccccacgggtgccccctgcctccccctccagtcacagcctggcacccccatcaggggagcggagccgcctggcacgtggttccaccatccgcagcaccttccatggtggccaggtccgggaccggcgggcagggggtgggggtggtgggggtgtgcagaatgggccccctgcctctcccacactggcccatgaggctgcacccctgcccgccgggcggccccgccccaccaccaacctcttcaccaagctgacctccaaactgacccgaagggttaccctcgatccctctaaacggcagaactctaaccgctgtgtttcgggcgcctctctgccccagggatccaagatcaggtcgcagacgaacctgagagaatcgggggacctgaggtcacaagttgccatctaccttgggatcaaacggaaaccgccccccggctgctccgattcccctggagtgtgaagctgaccagctcgcgccctcctgaggccctgatggcagctctgcgccaggccacagcagccgcccgctgccgctgccgccagccacagccgttcctgctggcctgcctgcacgggggtgcgggcgggcccgagcccctgtcccacttcgaagtggaggtctgccagctgccccggccaggcttgcggggagttctcttccgccgtgtggcgggcaccgccctggccttccgcaccctcgtcacccgcatctccaacgacctcgagctctgagccaccacggtcccagggcccttactcttcctctcccttgtcgccttcacttctacaggaggggaaggggccagggaggggattctccctttatcatcacctcagtttccctgaattatatttgggggcaaagattgtcccctctgctgttctctggggccgctcagcacagaagaaggatgagggggctcagcggggggagctggcaccttcctggagcctccagccagtcctgtcctccctcgccctaccaagagggcacctgaggagactttggggacagggcaggggcagggagggaaactgaggaaatcttccattcctcccaacagctcaaaattaggccttgggcaggggcagggagagctgctgagcctaaagactggagaatctgggggactgggagtgggggtcagagaggcagattccttcccctcccgtcccctcacgctcaaacccccacttcctgccccaggctggcgcggggcactttgtacaaatccttgtaaataccccacaccctcccctctgcaaaggtctcttgaggagctgccgctgtcacctacggtttttaagttattacaccccgaccctcctcctgtcagccccctcacctgcagcctgttgcccaataaatttaagagagtccccccctccccaatgctgaccctaggattttccttccctgccctcacctgcaaatgagttaaagaagaggcgtgggaatccaggcagtggtttttcctttcggagcctcggttttctcatctgcagaatgggagcggtgggggtgggaaggtaaggatggtcgtggaagaaggcaggatggaactcggcctcatccccgaggccccagttcctatatcgggccccccattcatccactcacactcccagccaccatgttacactggactctaagccacttcttactccagtagtaaatttattcaataaacaatcattgacccatgcctactccatgccaggcccagtgctggacacagagacatgaagctctgtctgtgggagacagggattctgacacagacaccggacaaaccattgtcttggggagcccagaagagaaagtgggcagggtggggtcattggggaagatgctctagaggaattaatgctggaatggggtgttgaaggatgagtaggagttagttaggcattgagtttgccctgggcaaaagcccagaagtgggagtatgtggtatatcttcagagaactgggtaatttcagtgtggctgctgtgttgggcatggatggagaatcagcaagagaaatgctgtattaggactaataatccatctacgctgcttaagcaaaaaggtatttgttggtttatgttacttaatagtccaggggcacctggcttcaggtaggtttgatccaggcatcaggccattgcatctattttttcagtgtaagttgaattctagtaatttttatcaagtaagggctcctttcctggtggcacagatgacttcagcagttagaagtttctatccctccagctttctgcagcagaaagaccctcattgtcagtttcccagcaaaagtcccagggcagactctcattggcccaaatgggccatgtgattttctctaaaccaatcactgtgactctagagtggccagactcagagctgcacttagtaggggttcctcaaaggaaggtcaagtgtcatgagcaggagaaaaggcatgggagctggacagattatagtggttgaagtctgtgcagtacagaagggcggagcttattcacacagcacctttggggccaaaatgaataagctggactttctccccatggcactggggaaccatggaagttcagggaacttcagggaagaggcttggtcaattcctgagagcatcctctgtgctggggacacagtggtaatcaagacagccccaacactgccctcatagagctcacagtccaatggaggaggcagatgtgtcctcaggcagcgactgggcagggctggtataggggagtccagaggtgatgcctgcctcagccagggagggcttcctggaggagaaggagccagctagacatggataggagtgcgttttaggcacagcaaatggcacatacaagggccagggagcaagagagaggacaggtcctcaacaaatggcatgtgactttgtaagtgtagaattgctgtgaggtatggggctaggggcgtcagtagggccttgaaggttatggacaggggcctgggctttcttccaagggcactgggggagccatggcaaggttgtaggtagggtagagatgggcgggtttgtgctatgtgcagggtggaagggagggaagttgacaggtcagaagatcaggaaagaggtcggggctggacagatggggagagcgcagatagatttaagagagtcctgtgaggcaaagtgggcaggacctggtaacaggtgtctggactgtggctttggctggctcagaaggtccccactggcgtgtgtggtctatgtagcctctgggtgtggagctgggatcttcaactggggacagtacagtaaagaacatcacagc

SEQ ID NO: 17179 - DNA, 1147 bp, Homo sapiens
ctccctcctagcatgatgacccgcagggttaccctcgatccctctaaacggcagaactctaaccgctgtgtttcgggcgcctctctgccccagggatccaagatcaggtcgcagacgaacctgagagaatcgggggacctgaggtcacaagttgccatctaccttgggatcaaacggaaaccgccccccggctgctccgattcccctggagtgtgaagctgaccagctcgcgccctcctgaggccctgatggcagctctgcgccaggccacagcagccgcccgctgccgctgccgccagccacagccgttcctgctggcctgcctgcacgggggtgcgggcgggcccgagcccctgtcccacttcgaagtggaggtctgccagctgccccggccaggcttgcggggagttctcttccgccgtgtggcgggcaccgccctggccttccgcaccctcgtcacccgcatctccaacgacctcgagctctgagccaccacggtcccagggcccttactcttcctctcccttgtcgccttcacttctacaggaggggaaggggccagggaggggattctccctttatcatcacctcagtttccctgaattatatttgggggcaaagattgtcccctctgctgttctctggggccgctcagcacagaagaaggatgagggggctcagcggggggagctggcaccttcctggagcctccagccagtcctgtcctccctcgccctaccaagagggcacctgaggagactttggggacagggcaggggcagggagggaaactgaggaaatcttccattcctcccaacagctcaaaattaggccttgggcaggggcagggagagctgctgagcctaaagactggagaatctgggggactgggagtgggggtcagagaggcagattccttcccctcccgtcccctcacgctcaaacccccacttcctgccccaggctggcgcggggcactttgtacaaatccttgtaaataccccacaccctcccctctgcaaaggtctcttgaggagctgccgctgtcacctacggtttttaagttattacaccccgaccctcctcctgtcagccccctcacctgcagcctgttgcccaataaatttaagagagtccccccctcccc

SEQ ID NO: 17180 - DNA, 1586 bp, Homo sapiens
cttggtggtggtggtggtggggcggcctgagaagatatcatggctgctgccacggagcttaatcgcccgagcagcggtgacaggaacctggagcgaagatgcagacccaacctctcccgagaggtgctctacgaaatctttcgctccctacacaccctggttggacagcttgacctcagagatgatgtggtgaaaattacaatcgattggaacaagctccagagcctctcggcattccagcctgcattgctctttagtgcacttgaacaacacattttatatttacagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctggaaaagcagaaattgacagacgaatatctgcatttattgaaagaaagcaagctgaaatcaatgaaaacaacgtcagggaattttgcaatgttattgattgtaatcaagaaaatagttgtgcaagaactgatgcgatttttaccccttaccccggatttaaaagtcacgtaaaagtttctagagttgtgaatacatacggaccacagactagacctgaaggaattccagggtcaggtcataaacctaacagcatgcttcgagactgtggtaatcaggctgtagaagaacgactacaaaatattgaggcccacttgcggttacagacaggtggtccagtgccaagagacatttatcagagaattaaaaaacttgaggataaaatccttgaattggaaggcatctctcctgaatattttcagtctgtaagcttttctggaaaaagaagaaaagttcaaccacctcaaaactattcactggctgaacttgatgagaaaattagtgccctcaaacaagccctcctcagaaaatcaagagaagcagaatccatggcaacccaccaccttccatgaaaaactcctctcatccttgtcattttacttttttgtatacatatgtgtaacttacactgttattaattcaacggatatatatttatcaatgtagacttctctgtgaagtcaaggtttattttcacatgagtccagcttgcagcaagtaatcttcaaatattccagtaagttttgaaataatgaatgcattgaaaatagcattgttggaatttattcccttctgttttaaaggaggtattttggaaattgaaaaacttaatttacaagtgctggtacatcttttttcttttgtggaccacaggaaggaagatttattttgatattgatactttaaaaggactttatatttgtaacattgatgttaaccagtttattagtttaaatcagtactttgcatataataagcattcaacaaaaatttattgactgaaatgaattttaaatgcatgtgtatgaacttgtttttcttaatctttaagatgtcagtattcatgtaaataaacaatagatccagc

SEQ ID NO: 17181 - DNA, 1642 bp, Homo sapiens
tcgccaagcgactaaagctggaagggagggggcggggttgtgagcaaatcttggtggtggtggtggtggggcggcctgagaagatatcatggctgctgccacggagcttaatcgcccgagcagcggtgacaggaacctggagcgaagatgcagacccaacctctcccgagaggtgctctacgaaatctttcgctccctacacaccctggttggacagcttgacctcagagatgatgtggtgaaaattacaatcgattggaacaagctccagagcctctcggcattccagcctgcattgctctttagtgcacttgaacaacacattttatatttacagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctggaaaagcagaaattgacagacgaatatctgcatttattgaaagaaagcaagctgaaatcaatgaaaacaacgtcagggaattttgcaatgttattgattgtaatcaagaaaatagttgtgcaagaactgatgcgatttttaccccttaccccggatttaaaagtcacgtaaaagtttctagagttgtgaatacatacggaccacagactagacctgaaggaattccagggtcaggtcataaacctaacagcatgcttcgagactgtggtaatcaggctgtagaagaacgactacaaaatattgaggcccacttgcggttacagacaggtggtccagtgccaagagacatttatcagagaattaaaaaacttgaggataaaatccttgaattggaaggcatctctcctgaatattttcagtctgtaagcttttctggaaaaagaagaaaagttcaaccacctcaacagaactattcactggctgaacttgatgagaaaattagtgccctcaaacaagccctcctcagaaaatcaagagaagcagaatccatggcaacccaccaccttccatgaaaaactcctctcatccttgtcattttacttttttgtatacatatgtgtaacttacactgttattaattcaacggatatatatttatcaatgtagacttctctgtgaagtcaaggtttattttcacatgagtccagcttgcagcaagtaatcttcaaatattccagtaagttttgaaataatgaatgcattgaaaatagcattgttggaatttattcccttctgttttaaaggaggtattttggaaattgaaaaacttaatttacaagtgctggtacatcttttttcttttgtggaccacaggaaggaagatttattttgatattgatactttaaaaggactttatatttgtaacattgatgttaaccagtttattagtttaaatcagtactttgcatataataagcattcaacaaaaatttattgactgaaatgaattttaaatgcatgtgtatgaacttgtttttcttaatctttaagatgtcagtattcatgtaaataaacaatagatccagcttta

SEQ ID NO: 17182 - DNA, 5990 bp, Homo sapiens
cccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaagtatttgggctaaatactctaatggagattgttactgaagccggccccgggagtggtgaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgaattgtggaacaagcaccaggaagtgaaaaagcaaaaagctttggaaaaacagaggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggaagggacaaaggatccatgtgggaccagttagaggatgcagctatggagaccttttctataagcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 17183 - DNA, 6005 bp, Homo sapiens
gatttcagcgctaaggcgtcggcggtgcacctcacgtgcatgtgtagcatgccttggtttttcctttggcatctgaaaaaggcacaacctgaaagacctagaacccagtgtcggtccccaggccctttgggacaggaagagaagagccgtgtggccgcggggaggatgtcctgaggcggggctgtcctcgcggactgactggactccatctcccagcgggcgccgcggcgcggccacgcccccccactccccgcgcgcgcccggtggagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 17184 - DNA, 5873 bp, Homo sapiens
cccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaagtatttgggctaaatactctaatggagattgttactgaagccggccccgggagtggtgaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 17185 - DNA, 5942 bp, Homo sapiens
ctggcgcccgctcggagcggcgccgcgctggggagcgactgacgccccgctgccgggggacgtcgggctgggcctggccagtcccccagagcttgggagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaagtatttgggctaaatactctaatggagattgttactgaagccggccccgggagtggtgaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgaattgtggaacaagcaccaggaagtgaaaaagcaaaaagctttggaaaaacagaggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggaagggacaaaggatccatgtgggaccagttagaggatgcagctatggagaccttttctataagcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcagttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 17186 - DNA, 4628 bp, Homo sapiens
accgcggccgcgcgcccccctctgcccccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcagctactcagaaggctgaggtgg

SEQ ID NO: 17187 - DNA, 4988 bp, Homo sapiens
aggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaag

SEQ ID NO: 17188 - DNA, 5823 bp, Homo sapiens
cgctcggagcggcgccgcgctggggagcgactgacgccccgctgccgggggacgtcgggctgggcctggccagtcccccagagcttgggagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactcc

SEQ ID NO: 17189 - DNA, 5684 bp, Homo sapiens
cccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 17190 - DNA, 5614 bp, Homo sapiens
cccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcagttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 17191 - DNA, 5744 bp, Homo sapiens
cccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaagtatttgggctaaatactctaatggagattgttactgaagccggccccgggagtggtgaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 17192 - DNA, 1699 bp, Homo sapiens
gtacccgaccgccagcgtcgcctgctgcgcaagtggggcctgcgagccaaccccgcctccgcccctcgattgggcgcgcatttaaatgtccggccccgccccgagctccgggcgcttatatataggcagctcggcgggcggcgggcggcattctggcgcggagcggagcggcggcgggcgcagctagcgggtcggccgcggagcggaggtgcagctcggcttcccccggcacccctccccctcgggcgccagccccacccctccgccggccgggccgaccccgccgtactatcccctgcggcgcgagcccggggcggctccaagcgccccccagcagacccccatcatgggcagccagagctccaaggctccccggggcgacgtgaccgccgaggaggcagcaggcgcttcccccgcgaaggccaacggccaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtccctttagtggtgc

SEQ ID NO: 17193 - DNA, 1448 bp, Homo sapiens
gcccgataccggtttcagagtcctgggcagcgtgcgcgctcttcctggcggctgcgcaggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaccacgcccagctaatttttttgtatttttagtagagatggggtttcaccgtgttagccaggatgatcttgatctcctgacctcg

SEQ ID NO: 17194 - DNA, 2153 bp, Homo sapiens
gcccgataccggtttcagagtcctgggcagcgtgcgcgctcttcctggcggctgcgcaggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtatttttagtagagacgaggtttcaccatgttggtcaggctgggaaactactttttttaaaaaatagcaagtttactatttatttactgcctttttaatgctagcctctgtggtagagaagcaagcgcttcccaaatcagcttccaattggtttaaccagtatgcaacattaaagattttactcagacattttt

SEQ ID NO: 17195 - DNA, 1584 bp, Homo sapiens
caggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtattgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccacctcccaaagtgttgggattacaggcgtgagtcaccgcgcccagctggtattgcttttctattccctttggacat

SEQ ID NO: 17196 - DNA, 4376 bp, Homo sapiens
cagagtcctgggcagcgtgcgcgctcttcctggcggctgcgcaggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtatttttagtagagacgaggtttcaccatgttggtcaggctgggaaactactttttttaaaaaatagcaagtttactatttatttactgcctttttaatgctagcctctgtggtagagaagcaagcgcttcccaaatcagcttccaattggtttaaccagtatgcaacattaaagattttactcagacatttttaaacgaattcaaatgttctaagggcctttactaagaatggaaaaaatcctgtgttcatctttcatctgtgaccaatttcatattcatctatctcatttaaatgtgtcatcattttagagatcgtatcctggcagtgtgatgggcaagtggaccatcaattctggtgctactttttccttttttactcaggcaggttcctaggatttttctgggacaaatttctcttcctagagaaattcctaggggatttctaaaggatttttctaagggaaaaagggtgacatctttcaaaggtgtcatttattcccttgaaaggtgtttgaatcccagatcaacattttcagacatcctgatcttgggcaaattgcttaatctctctgtgcctgtttcctcttctgtaaaatggggctaataatagttccttcctcatagagttgttaggattaaaggagttactaatatggtaggaactatattagtgtttgtgaagtctactgaagtgtttgtgaaatgaataaattataaagaatgagtctcaagaaaaggtccttaatgagcaagcccaacctacttaaccaaaagcccaagtgtctggtgcctttctggtttgtggtgttaactcatggccttagcctggtgcttcactgtggctctgtggcccctggggttccacatggcctccctgtctttcatcagtgtgactgtacatctctccatctccccatagtccagcctgccctggacacattgaattgtatgaatggtattgcttttttttttttttttttgtgagacagagtcttactctgttgcccagactggagtgcagtggtgcgatctcggctcactgcaagctccgcctcccaagttcacgtcattttcctgcctcagcctcccgagtagctgggactacaggcacctgccaccacgcccagctaatttttttgtatttttagtagagatggggtttcaccgtgttagccaggatgatctcgatctcctgacctcatgatccacccgcctcagcctcccaaagtgttgggattacaggcgtgagtcaccgcgcccagctggtattgcttttctattccctttggacatacatgctacagtcccacaatgtagcatttccttggaaactccctttttttttttttttgagatggagtttcgctcttgttgcccaggctggagtacagtggtatgatcttggctcactgcagcctctgcctcctgggttcaagcgattctcctgcctctgcctcccaagtagctgggattacaggcacccaccaccatgcccagctaattttttgtatttttagtagagacaggatttcactatgttggccaggttggtctcaagctcctgacctcagatgatctaccagcctcggccttctgaagtgctgggattcaggtgtgagccactgtgcccagcagggatgcttcatctttctaagaattatcttggctttggactttattcataaatgttttatttctgttagtatgaacaatagactgccttaacaaagtttttttttaaacaaaatcgttcttgttggattttattcagcagcatctatcatgtagataaattcccaggtgtagcattacagcttctgactaatatagctgccattcagacaattaatgttcaaagagttttctaaagtgataaaaccaaagaaaagcatgtggaaaagcagaagcttagaaagttgtggtcactgaatgcactccctggtttttatttgtcagtgaaatctttatgcattcattgttaatattttaattccatggctttgtaggctgtgctgtgtctgaaggggtaacacctagggaaacatgaggccccttatgggaccccccaaatggaacaacttcactttctcttttatgtattgagccctgtgttaacatttcacttaagaagagcaccagtgctttaaaaaaaaaaaaaggtaaaatattaccattttgatagactgtaaagagttagattcctgttgaagtgttaaggaaatttaactttgtgaaacttttaaaataaagtttataaatgtagctaatctttgaaaaaccaatgcagtaacactgatttgtaaatgttgtggtcaatccctaggtgcattaaagtttcagtcacctgccgtgtgtgtgtgtgcccttttatgtttgccttcctagcattcctgtgttcactgtgcatgttcttgaaaatattttcacttgtcagaaaataaactggaaagtcattgaaaacccgta

SEQ ID NO: 17197 - DNA, 1908 bp, Homo sapiens
gcggggcggggcgcgcacctcggggcgatctcggtgctccttacctgggaggtctcccggcttagtttcggcctcgttgggtcggaatctccaaagacagtgggtttcagccagaaacgcgaagacgaacgcctagccggcgcgggcagaaccgaggacacaatgagatttgtgggaccgggcgcccagaggctggcgcgggggagaccccacagctaaaatgctcggtacccccgggcagtcgtgggttagttagaaccgcagagcctttcccgacccctcggaagcgcagaagtatccgaaatctacccgtttcttgggtccagcaaaacttttaagccaggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaa

SEQ ID NO: 17198 - DNA, 576 bp, Homo sapiens
cccaggtgtgctgcgacggacggctgcccgcgctcggcgctcagcctgccatagcccgcgggggaggccggagccagggatccggggaggcccgcgtcccgccaggtttcgctctgcggacgcaggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagtt

SEQ ID NO: 17199 - DNA, 2912 bp, Homo sapiens
tgttgccctcaggtcgctcccgggcggggacacggaacccggccatggaagatccgtcgggggctcgcgagccccgggcccggccgagagagcgggacccgggacggcgcccccacccagaccaaggccgcacccacgatcgaccgcgggaccgacccggggacccgcgcaggaagcgaagcagcgacgggaaccggcgaagggacggggaccgggacccggagagagaccaggagagggacgggaaccgcgaccggaaccgggaccgggagagggagagagagagggaaagagacccggaccgaggcccccgccgggacacacacagggacgcgggccctcgcgcaggtgaacacggagtttgggaaaaaccgcgccaaagccggacgcgggacggagcccggggactgacctgggacgcagccgcgcctcctgggcccgcgccctgggaagccccggagccgccgcagccgcagaggaagggagaccccgggcgccgcagacccgaaagtgaacccccttcggagagatatctgccctcgacccccaggcctggacgagaggaggtggaatattaccagtcagaggcggaaggactcctggaatgccacaaatgcaaatacttgtgcactgggagagcctgctgccaaatgctggaggttctcctgaacttgctgatcctggcctgcagctctgtgtcttacagttccacagggggctacacgggcatcaccagcttggggggcatttactactatcagttcggaggggcttacagtggctttgatggtgctgacggggagaaggcccagcaactggatgtccagttctaccagctaaagctgcccatggtcactgtggcaatggcctgtagtggagccctcacagccctctgctgcctcttcgttgccatgggtgtcctgcgggtcccgtggcattgtccactgttgctggtgaccgaaggcttgttggacatgctcatcgcgggggggtacatcccggccttgtacttctacttccactacctctctgctgcctatggctctcctgtgtgtaaagagaggcaggcgctgtaccaaagcaaaggctacagcggtttcggctgcagtttccacggagcagatataggagctggaatctttgctgccctgggcattgtggtctttgccctgggggctgtcctggccataaagggctaccgaaaagttaggaagctaaaagagaagccagcagaaatgtttgaattttaagggtttctaaaacgctctgacagatgcaagtggtggtggaaggtagtctgagccactgcctttcccaagaatcccttgttgtggaagtttccagtgctggaaaagcagcgagccagcgttggtgtggtgggcggagctcccagtcgcatggagcggtgttcatggatgcaacagaccctggcttctggagtcctctgtgagtgagggaccaatcaaaattatttttcaaaaagcaaaaaaatggccggcctcggcggctcacacctgtaaccccagcactttgggaggctgaggtgggtggatcacttgaggtcaggagctcgagaccagcttggccaacatggtgagcccccgtctctactaaaatacaaaaaaattagccaggcgtggtggcgggcgcctgtaatcccagctacttgggaggctgaggcaggagaatcgcttgaatctgggaggcggagattgcagtgagccgagatcccgccactgcactccagcccaggtgacagagcgagactccatctcaaaaaaaaaaaaaagcaaaaaaactggaccccaagagccacaaggaaaaagcatgtactacaacagagtgcacctcttcattcagtaaagggaggtcaccaagagaatttgatgaaccttaccttcaaagttcctgggcacagtggctcacacctgtaatcccagagctttgggaggctgaggtaggaggattgcttgaacccaggagttcaagtttgcagtgcgctatgattgtcccactacactctagcctgagcaacagaccaagaccgtattgccaaaataccaaaaaaaaaaaaagttcatggagagccacatagacatgagaccacacttcagcctgaatttttctaaaacacagttgtctcaagcagattactccacacgtttttccacactgaactctccagtccttccacttccttaattctgcaaatggagggggtggggactcttgggaaactactcctgtaaaattgaagttggaggtaggcgtgggctgaggaaagaggaatcagattaattctctgggttgcaaagaggctattctgcaagccccttacagtggccctgaaagctcaataagtgttttgtacctcttgtaaatgtgccattgtgtgaagcattaaacccaacatctagaattcaggattcatccagaataaaaggatgtaaaatctttcccaacagaagagtgttacttttggtcagacaacttcatgggttcttactgcacattaaattatgacttatggaacattgcaatatattctcggtccttaagttatgacttatggaacattacaatatattctcggtccaagtgagtaagttctttgctttatgtgaatccaataaaaaatccaaagaattttaatttggagttgatgtcctctttacaatacatttataatattctcttaaatacagacaatttttcacatttaaaaggtgagttccatttgagtttagaaaaggaaatatatatatacatgcttgtatatgattggaaaatttcttgaagaataacatcagaaagtattaagttttgcttttgaagagaaggggacttttcatttatacatggcttgactgcacatgtattaattttagaaaaataaaaagtaaaaaagttga

SEQ ID NO: 17200 - DNA, 2214 bp, Homo sapiens
gttgccctcaggtcgctcccgggcggggacacggaacccggccatggaagatccgtcgggggctcgcgagccccgggcccggccgagagagcgggacccgggacggcgcccccacccagaccaaggccgcacccacgatcgaccgcgggaccgacccggggacccgcgcaggaagcgaagcagcgacgggaaccggcgaagggacggggaccgggacccggagagagaccaggagagggacgggaaccgcgaccggaaccgggaccgggagagggagagagagagggaaagagacccggaccgaggcccccgccgggacacacacagggacgcgggccctcgcgcaggtgaacacggagtttgggaaaaaccgcgccaaagccggacgcgggacggagcccggggactgacctgggacgcagccgcgcctcctgggcccgcgccctgggaagccccggagccgccgcagccgcagaggaagggagaccccgggcgccgcagacccgaaagtgaacccccttcggagagatatctgccctcgacccccaggcctggacgagaggaggtggaatattaccagtcagaggcggaaggactcctggaatgccacaaatgcaaatacttgtgcactgggagaggtgtggtgcagatagtggaggtggtcttgaatgggatggttctcatatgcatcgtggcctcctactttgtccttgccggattcagtgccagcttttccagcggcggtggctttgggaacaactactactcaccgttcgagggcactgagctagagcaggttcggcagctggaccagcagtacacgatcctccgctcgcccctgatatacggtggcgtggctgtttctctgggtctgggggtcctcaccatgggtgttttactccaaggagccaagagtcgaacaatgttgtcagggaagtggctcctcacggaggccgccttcagcctcctagcggcagtgggctactgcacaggcattggtgtttacctccacgtggctctgcagatcaatagcaccgacacttgcaaaacaagagagaggctctatgcccgcaagggtctcacctggatggactgccagctggcaggcaccgacggagcagcagccacctttgcttgtcttctcgtgatcatgtacggcgccagcgtggtgctggccctgcgtagctaccgagaacagaagcgctacaaaggcagccgagaacagcccggaagttacagtgatgcaccggaatatctgtggtctggaactctttgagatcttccggaacctaaatgtgaacgcacattgtttctctcaaaaagacaggtcttttaaaactccgcattagacaactatggttttcacacacttgactttataaatgctctctttggactgaggcaaagttaaagaattgaggacgggcatggtggctcatgcctgtaatcccagcactttgggaggctgaggtgggcggatcgcttgaggtcagcagattgagtccagcctggctcacatagcgaaaccctgtctctactaaaaatacaaaaaatcgccgggcatggtggctcacgcctgtaatcccagcactttaggaggccaaggcaggcagatcacctgaggtcaggtgtttgaaaccagtctggcaaacatggtgaaaccccatctctactaaaaatacaaaaattagctgggcgtggtggcaggcacctgtaattccagctactctggaggctgaggcaggagaatctcttaaacccgggaggcagaggttgcagtgagccaagaccattgcactccagcctgggcaacaagagcgagactccgtctcaaaaaaatacaaaaaatcatctgggcttggtggtgaacgcctgtaatcccagttactcaggaggctaaaccacaagaatcacttgaacctgggaggcagaggttgcagtgagcaaactccactccacgtcactgcactccagcctgggtaacagagcgaggctctgtctcaaaaacaacaactacaacaaaaaagataggacagtagattttattagaccctgaagcatactggaggctttttcatttctgcattccctgacagtgctccatagagtaggtcttcaaaggtagatagtaatctcattaccctggactgttctcataatgtaacagatcactaacactgaatcttaaaaataaagttcttttagtaattttaa

SEQ ID NO: 17201 - DNA, 1135 bp, Homo sapiens
cctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagctttcttctggccattactacacaattgtcacattatcagtgacttttctgtttggctacaacacgggcctctatctgctgacggccattagtgtggagaggtgcctgtcagtcctttaccccatctggtaccgatgccatcgccccaagtaccagtcggcattggtctgtgcccttctgtgggctctttcttgcttggtgaccaccatggagtatgtcatgtgcatcgacagagaagaagagagtcactctcggaatgactgccgagcagtcatcatctttatagccatcctgagcttcctggtcttcacgcccctcatgctggtgtccagcaccatcttggtcgtgaagatccggaagaacacgtgggcttcccattcctccaagctttacatagtcatcatggtcaccatcattatattcctcatcttcgctatgcccatgagactcctttacctgctgtactatgagtattggtcgacctttgggaacctacaccacatttccctgctcttctccacaatcaacagtagcgccaaccctttcatttacttctttgtgggaagcagtaagaagaagagattcaaggagtccttaaaagttgttctgaccagggctttcaaagatgaaatgcaacctcggcgccagaaagacaattgtaatacggtcacagttgagactgtcgtctaagaactgtgagggaagttgtggataaaaatggtggaacacaggtcatttttagtttgtgcttggaatatgacttaagtatctcctaaatgtgatacagaagaacatctcatcccatatgcatgagatactaattaatgatgaaa

SEQ ID NO: 17202 - DNA, 1265 bp, Homo sapiens
actagatggaccactgctcctgactgtgatgttgtggcccactcaggtcccagcaccccatggtctgggggaaaatttgctggttcagccagagggctggatggacagtgtttgctgagtcacagatatctctctcatgtagcctttgtctccacagtggtgaccaggaggcacagaacccaaacctggtatctcagctctgtggcgtctttcttcaaaatgagacgaatgaaaccatacatatgcagatgagcatggcagtgggacagcaggccctgcccttgaatatcattgcccccaaggctgtgctggtctccctctgtggggtcttattgaatggcactgtcttctggctgctttgctgtggggccacgaatccctacatggtatacatcctccacctggtcgctgctgacgtgatctatctttgctgctcggcagtggggttcttacaggtgactctgctaacttatcatggagtcgtgttttttatccctgatttcctggccatattgtctcccttctcctttgaggtgtgtctctgtctcctggtggccatcagcacagagcggtgtgtgtgtgtcctcttccccatctggtacagatgccaccgcccaaaatacacatctaatgttgtctgcaccctcatctggggcctgcctttttgcatcaacatagtaaaatcacttttcctaacttactggaaacatgtaaaggcatgtgtcatatttctaaagctttctgggctcttccatgctatcctttcacttgtgatgtgtgtgtcgagtctgactctactcattagattcctgtgctgctcccagcagcaaaaggccaccagggtctatgcggtggtgcagatctcggcccccatgttcctactctgggccctacccctgagcgtggcacccctcataacagatttcaaaatgtttgtcaccacctcctatttaatttccttgttcctcattataaacagcagcgccaaccctatcatttatttctttgtggggagcctcagaaagaaaaggctgaaggaatctctcagagtgattctccaacgggcgttagcagataagccagaggtggggaggaacaaaaaggcagctggcatcgacccaatggagcaaccacactctactcagcatgtggagaaccttcttcccagggagcacagggtcgatgtggaaacataatttcccacatctgagctggggaattgtacacatagtaacccagcctgttctgcatcataaggctgctgc

SEQ ID NO: 17203 - DNA, 1265 bp, Homo sapiens; identical to SEQ ID NO: 17202

SEQ ID NO: 17204 - DNA, 1265 bp, Homo sapiens; identical to SEQ ID NO: 17202

SEQ ID NO: 17205 - DNA, 1265 bp, Homo sapiens; identical to SEQ ID NO: 17202

SEQ ID NO: 17206 - DNA, 1265 bp, Homo sapiens; identical to SEQ ID NO: 17202

SEQ ID NO: 17207 - DNA, 1265 bp, Homo sapiens; identical to SEQ ID NO: 17202

SEQ ID NO: 17208 - DNA, 1265 bp, Homo sapiens; identical to SEQ ID NO: 17202

SEQ ID NO: 17209 - DNA, 1265 bp, Homo sapiens; identical to SEQ ID NO: 17202

SEQ ID NO: 17210 - DNA, 966 bp, Homo sapiens
atgaaccagactttgaatagcagtgggaccgtggagtcagccctaaactattccagagggagcacagtgcacacggcctacctggtgctgagctccctggccatgttcacctgcctgtgcgggatggcaggcaacagcatggtgatctggctgctgggctttcgaatgcacaggaaccccttctgcatctatatcctcaacctggcggcagccgacctcctcttcctcttcagcatggcttccacgctcagcctggaaacccagcccctggtcaataccactgacaaggtccacgagctgatgaagagactgatgtactttgcctacacagtgggcctgagcctgctgacggccatcagcacccagcgctgtctctctgtcctcttccctatctggttcaagtgtcaccggcccaggcacctgtcagcctgggtgtgtggcctgctgtggacactctgtctcctgatgaacgggttgacctcttccttctgcagcaagttcttgaaattcaatgaagatcggtgcttcagggtggacatggtccaggccgccctcatcatgggggtcttaaccccagtgatgactctgtccagcctgaccctctttgtctgggtgcggaggagctcccagcagtggcggcggcagcccacacggctgttcgtggtggtcctggcctctgtcctggtgttcctcatctgttccctgcctctgagcatctactggtttgtgctctactggttgagcctgccgcccgagatgcaggtcctgtgcttcagcttgtcacgcctctcctcgtccgtaagcagcagcgccaaccccgtcatctacttcctggtgggcagccggaggagccacaggctgcccaccaggtccctggggactgtgctccaacaggcgcttcgcgaggagcccgagctggaaggtggggagacgcccaccgtgggcaccaatgagatgggggcttga

SEQ ID NO: 17211 - DNA, 1409 bp, Homo sapiens
aggttcagggtttctcttgctgtccacacctgggcgagagctgagcggaagagaaggggtcctcagagagacaccttcctgaccggccccattccagctggatgccatgtgactcggaggagctggtggacactgaacaggagccgcccagaggctctggggactggagccctcggccgcggccaggatagatccaaggcccagggtcagagcaggcagggctcggccagtcctctgccccaaacggggcatcaggagagagagcgagcagaacacactcctgcagcatcccctggccccccgccccatgatggagcccagagaagctggacagcacgtgggggccgccaacggcgcccaggaggatgtggccttcaacctcatcatcctgtccctcaccgaggggctcggcctcggtgggctgctggggaatggggcagtcctctggctgctcagctccaatgtctacagaaaccccttcgccatctacctcctggacgtggcctgcgcggatctcatcttccttggctgccacatggtggccatcgtccccgacttgctgcaaggccggctggacttcccgggcttcgtgcagaccagcctggcaacgctgcgcttcttctgctacatcgtgggcctgagtctcctggcggccgtcagcgtggagcagtgcctggccgccctcttcccagcctggtactcgtgccgccgcccacgccacctgaccacctgtgtgtgcgccctcacctgggccctctgcctgctgctgcacctgctgctcagcggcgcctgcacccagttcttcggggagcccagccgccacttgtgccggacgctgtggctggtggcagcggtgctgctggctctgctgtgttgcaccatgtgtggggccagccttatgctgctgctgcgggtggagcgaggcccccagcggcccccaccccggggcttccctgggctcatcctcctcaccgtcctcctcttcctcttctgcggcctgcccttcggcatctactggctgtcccggaacctgctctggtacatcccccactacttctaccacttcagcttcctcatggccgccgtgcactgcgcggccaagcccgtcgtctacttctgcctgggcagtgcccagggccgcaggctgcccctccggctggtcctccagcgagcgctgggagacgaggctgagctgggggccgtcagggagacctcccgccggggcctggtggacatagcagcctgagccctggggcccccgaccccagctgcagcccccgtgaggcaagagggtgacttggggaaggtggtggggtcagaggctggggccagccggacctggaggaggccttggtgggtgacccggtcatgtgctgtcaaagttgtgacccttggtctggagcatgagg

SEQ ID NO: 17212 - DNA, 1454 bp, Homo sapiens
aggttcagggtttctcttgctgtccacacctgggcgagagctgagcggaagagaaggggtcctcagagagacaccttcctgaccggccccattccagctggatgccatgtgactcggaggagctggtggacactgaacaggagccgcccagaggctctggggactggagccctcggccgcggccaggatagatccaaggcccagggtcagagcaggcagggctcggccagtcctctgccccaaacggggcatcaggagagagagcgagcagaacacactcctgcagcatcccctggccccccgccccatgatggagcccagagaagctggacagcacgtgggggccgccaacggcgcccaggaggatgtggccttcaacctcatcatcctgtccctcaccgaggggctcggcctcggtgggctgctggggaatggggcagtcctctggctgctcagctccaatgtctacagaaaccccttcgccatctacctcctggacgtggcctgcgcggatctcatcttccttggctgccacatggtggccatcgtccccgacttgctgcaaggccggctggacttcccgggcttcgtgcagaccagcctggcaacgctgcgcttcttctgctacatcgtgggcctgagtctcctggcggccgtcagcgtggagcagtgcctggccgccctcttcccagcctggtactcgtgccgccgcccacgccacctgaccacctgtgtgtgcgccctcacctgggccctctgcctgctgctgcacctgctgctcagcggcgcctgcacccagttcttcggggagcccagccgccacttgtgccggacgctgtggctggtggcagcggtgctgctggctctgctgtgttgcaccatgtgtggggccagccttatgctgctgctgcgggtggagcgaggcccccagcggcccccaccccggggcttccctgggctcatcctcctcaccgtcctcctcttcctcttctgcggcctgcccttcggcatctactggctgtcccggaacctgctctggtacatcccccactacttctaccacttcagcttcctcatggccgccgtgcactgcgcggccaagcccgtcgtctacttctgcctgggcagtgcccagggccgcaggctgcccctccggctggtcctccagcgagcgctgggagacgaggctgagctgggggccgtcagggagacctcccgccggggcctggtggacatagcagcctgagccctggggcccccgaccccagctgcagcccccgtgaggcaagagggtgacttggggaaggtggtggggtcagaggctggggccagccggacctggaggaggccttggtgggtgacccggtcatgtgctgtcaaagttgtgacccttggtctggagcatgaggctcccctgggaggcagctggaaaggcaaggtctctacatgcccag

SEQ ID NO: 17213 - DNA, 2295 bp, Homo sapiens
gatgagttcccggtggggctctggggggggctcctgagcggggcattccttcctgaagcctcatccccgctcagccctgctcagcccctcctcctactcccctccccctccccctcctgccgggccaggaattgggtttggggcgggttctgcttccaaagccatctcttccagcaggagagggctctactctgagctcctattttccaaggctccgggccgcgctcggcgctggcctgctgccccggcgggtccgccggccggaggcgggagtcacaggaagagccctccacaaaaggaggcctcggcggatcaggacagctgcaggtgggtgtgcagactggtgagctgccagcaggggcccagacgcgccaggcctggagatggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggcccccggcgcggcctgcaggcacatggacatcttcctgggcatcctcctgttcctgctctgctgcccgctcatggtgctgccctgcctggccctcatcctgcacgtggagtgccgggcccgacggcgccagcgctctgccaagctcaaccacgtcatcctggccatggtctccgtcttcctggtgtcctccatctacttagggatcgactggttcctcttctgggtcttccagatcccggcccccttccccgagtacgtcactgacctgtgcatctgcatcaacagcagcgccaagcccatcgtctacttcctggccgggagggacaagtcgcagcggctgtgggagccgctcagggtggtcttccagcgggccctgcgggacggcgctgagctgggggaggccgggggcagcacgcccaacacagtcaccatggagatgcagtgtcccccggggaacgcctcctgagactccagcgcctggaggaggcaggggcaggaagcggcctccaagacccttcgccttgggacaggaatgggcacctgcttctgagtccatacaggagaagaaagatctgtttcctctcctcgggcctccttctccctgggctggggactccaggggtggctgggagactgggcagccaccagcaaacagaccctgtggcccctgcccggctcccccacccattctgctcccctagagacctcttgtacagaagttgcccccaggtggtggggcccctccttgccctaggctggttggtaaaagagaggaggtcaacacccagcctagccacctctgcctcttgggtcagccctccttgactgtgtcccagccagcaccaggccagcagcctcatccctgccattcagggctgttccagagattcgatcctcttaaggcattatcagtgagcaaatgtgaaggaaatggtgtctggaagaaagttctggttcacatgccttgtagctaagtctttctgcaaacaacctcccttccccccgtcgagtcatttggtgactttgatggggggatttctggttatgtcaaggctctggagacaggaagggcctttggccgccttgggtagttgacctgccttttctgactccgggacgagccagtcctaggctgcctccgggagcacttgaggtatcccgcaggccatgaggacccactgggcagctcctggacagcctcttggctccagcccccacccgaaagtggacactggctccgccctggccacctggggactggcactgtggtgcacagtggcccaatgtggccaacggaagttttataaaagacaaaatgtatatcaataaacattttataacttgca

SEQ ID NO: 17214 - DNA, 1301 bp, Homo sapiens
atctcttccagcaggagagggctctactctgagctcctattttccaaggctccgggccgcgctcggcgctggcctgctgccccggcgggtccgccggccggaggcgggagtcacaggaagagccctccacaaaaggaggcctcggcggatcaggacagctgcaggtgggtgtgcagactggtgagctgccagcaggggcccagacgcgccaggcctggagatggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggcccccggcgcggcctgcaggcacatggacatcttcctgggcatcctcctgttcctgctctgctgcccgctcatggtgctgccctgcctggccctcatcctgcacgtggagtgccgggcccgacggcgccagcgctctgccaagctcaaccacgtcatcctggccatggtctccgtcttcctggtgtcctccatctacttagggatcgactggttcctcttctgggtcttccagatcccggcccccttccccgagtacgtcactgacctgtgcatctgcatcaacagcagcgccaagcccatcgtctacttcctggccgggagggacaagtcgcagcggctgtgggagccgctcagggtggtcttccagcgggccctgcgggacggcgctgagctgggggaggccgggggcagcacgcccaacacagtcaccatggagatgcagtgtcccccggggaacgcctcctgagactccagcgcctggaggaggcaggggcaggaagcggcctccaagacccttcgccttgggacaggaatgggcacctgcttctgagtccatacaggagaagaaagatctgtttcctctcctcgggcctccttct

SEQ ID NO: 17215 - DNA, 2282 bp, Homo sapiens
gggctcctgagcggggcattccttcctgaagcctcatccccgctcagccctgctcagcccctcctcctactcccctccccctccccctcctgccgggccaggaattgggtttggggcgggttctgcttccaaagccatctcttccagcaggagagggctctactctgagctcctattttccaaggctccgggccgcgctcggcgctggcctgctgccccggcgggtccgccggccggaggcgggagtcacaggaagagccctccacaaaaggaggcctcggcggatcaggacagctgcaggcttctgccaggtgggtgtgcagactggtgagctgccagcaggggcccagacgcgccaggcctggagatggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggcccccggcgcggcctgcaggcacatggacatcttcctgggcatcctcctgttcctgctctgctgcccgctcatggtgctgccctgcctggccctcatcctgcacgtggagtgccgggcccgacggcgccagcgctctgccaagctcaaccacgtcatcctggccatggtctccgtcttcctggtgtcctccatctacttagggatcgactggttcctcttctgggtcttccagatcccggcccccttccccgagtacgtcactgacctgtgcatctgcatcaacagcagcgccaagcccatcgtctacttcctggccgggagggacaagtcgcagcggctgtgggagccgctcagggtggtcttccagcgggccctgcgggacggcgctgagctgggggaggccgggggcagcacgcccaacacagtcaccatggagatgcagtgtcccccggggaacgcctcctgagactccagcgcctggaggaggcaggggcaggaagcggcctccaagacccttcgccttgggacaggaatgggcacctgcttctgagtccatacaggagaagaaagatctgtttcctctcctcgggcctccttctccctgggctggggactccaggggtggctgggagactgggcagccaccagcaaacagaccctgtggcccctgcccggctcccccacccattctgctcccctagagacctcttgtacagaagttgcccccaggtggtggggcccctccttgccctaggctggttggtaaaagagaggaggtcaacacccagcctagccacctctgcctcttgggtcagccctccttgactgtgtcccagccagcaccaggccagcagcctcatccctgccattcagggctgttccagagattcgatcctcttaaggcattatcagtgagcaaatgtgaaggaaatggtgtctggaagaaagttctggttcacatgccttgtagctaagtctttctgcaaacaacctcccttccccccgtcgagtcatttggtgactttgatggggggatttctggttatgtcaaggctctggagacaggaagggcctttggccgccttgggtagttgacctgccttttctgactccgggacgagccagtcctaggctgcctccgggagcacttgaggtatcccgcaggccatgaggacccactgggcagctcctggacagcctcttggctccagcccccacccgaaagtggacactggctccgccctggccacctggggactggcactgtggtgcacagtggcccaatgtggccaacggaagttttataaaagacaaaatgtatatcaataaacattttataacttgcagcc

SEQ ID NO: 17216 - DNA, 870 bp, Homo sapiens
atgtttgggctgttcggcctctggagaaccttcgacagtgtggtcttctacctgacgctgatcgtgggcctcgggggaccggtaggtaacgggctggtgctctggaacctcggcttccgcatcaagaagggccccttctccatctacctgctgcacctggccgccgccgacttcctgttcctctcctgccgtgtgggcttctccgtggctcaggctgccctgggcgcccaggacacactctacttcgtgctcaccttcctgtggttcgcggtggggctctggctgctggcggccttcagcgtggagcgctgcctctccgacctcttccccgcctgctaccagggctgccggcccagacacgcctcggccgtcctctgcgccctggtgtggaccccgaccctgccggccgtgccgctgcccgccaacgcctgcggcctgctgcgcaacagcgcgtgccccctggtctgcccgcgctaccacgtggccagcgtcacctggttcctggtgctggcccgcgtcgcctggacggctggcgtggtcctctttgtctgggtgacctgctgctccactcgcccgcggcccaggctctacggcatcgtcctgggcgcgctgctcctgctcttcttctgtggcctgccctcggtcttctactggagcctgcagcccctgctgaacttcctgctgcccgtgttttccccgctggccacgctgctggcctgcgtcaacagcagctccaagcccctcatctactcggggttgggccgacagcccgggaagcgggagccgctgaggtcggtactgcggagggccctgggggagggcgccgagctgggtgccaggggacagtccctgcccatgggtctcctataa

SEQ ID NO: 17217 - DNA, 1197 bp, Homo sapiens
tagagagaggtcaggcttcagagtcagcaagaactggatttcaaactggatttgaggacccccaccttttgataggtgacttattctctgtgagtctctgatctgccctctttaaatgaggaagtaaatcccacatggcagggtggtggggagaatcagagatcatacagctggtgatcacaactggtttctgtttccagggtcaccagactagggtttctgagcatggatccaaccatctcaaccttggacacagaactgacaccaatcaacggaactgaggagactctttgctacaagcagaccttgagcctcacggtgctgacgtgcatcgtttcccttgtcgggctgacaggaaacgcagttgtgctctggctcctgggctgccgcatgcgcaggaacgccttctccatctacatcctcaacttggccgcagcagacttcctcttcctcagcggccgccttatatattccctgttaagcttcatcagtatcccccataccatctctaaaatcctctatcctgtgatgatgttttcctactttgcaggcctgagctttctgagtgccgtgagcaccgagcgctgcctgtccgtcctgtggcccatctggtaccgctgccaccgccccacacacctgtcagcggtggtgtgtgtcctgctctgggccctgtccctgctgcggagcatcctggagtggatgttatgtggcttcctgttcagtggtgctgattctgcttggtgtcaaacatcagatttcatcacagtcgcgtggctgatttttttatgtgtggttctctgtgggtccagcctggtcctgctgatcaggattctctgtggatcccggaagataccgctgaccaggctgtacgtgaccatcctgctcacagtactggtcttcctcctctgtggcctgccctttggcattcagtttttcctatttttatggatccacgtggacagggaagtcttattttgtcatgttcatctagtttctattttcctgtccgctcttaacagcagtgccaaccccatcatttacttcttcgtgggctcctttaggcagcgtcaaaataggcagaacctgaagctggttctccagagggctctgcaggacgcgtctgaggtggatgaaggtggagggcagcttcctgaggaaatcctggagctgtcgggaagcagattggagcagtgagga

SEQ ID NO: 17218 - DNA, 2036 bp, Homo sapiens
gtttgccagtcccaggaaagcacttctcaactcaccaactccagtagaaagaagggtgttaaggggcaccagtggaggttttctgagcatggatccaaccaccccggcctggggaacagaaagtacaacagtgaatggaaatgaccaagcccttcttctgctttgtggcaaggagaccctgatcccggtcttcctgatccttttcattgccctggtcgggctggtaggaaacgggtttgtgctctggctcctgggcttccgcatgcgcaggaacgccttctctgtctacgtcctcagcctggccggggccgacttcctcttcctctgcttccagattataaattgcctggtgtacctcagtaacttcttctgttccatctccatcaatttccctagcttcttcaccactgtgatgacctgtgcctaccttgcaggcctgagcatgctgagcaccgtcagcaccgagcgctgcctgtccgtcctgtggcccatctggtatcgctgccgccgccccagacacctgtcagcggtcgtgtgtgtcctgctctgggccctgtccctactgctgagcatcttggaagggaagttctgtggcttcttatttagtgatggtgactctggttggtgtcagacatttgatttcatcactgcagcgtggctgatttttttattcatggttctctgtgggtccagtctggccctgctggtcaggatcctctgtggctccaggggtctgccactgaccaggctgtacctgaccatcctgctcacagtgctggtgttcctcctctgcggcctgccctttggcattcagtggttcctaatattatggatctggaaggattctgatgtcttattttgtcatattcatccagtttcagttgtcctgtcatctcttaacagcagtgccaaccccatcatttacttcttcgtgggctcttttaggaagcagtggcggctgcagcagccgatcctcaagctggctctccagagggctctgcaggacattgctgaggtggatcacagtgaaggatgcttccgtcagggcaccccggagatgtcgagaagcagtctggtgtagagatggacagcctctacttccatcagatatatgtggctttgagaggcaactttgcccctgtctgtctgatttgctgaactttctcagtcctgattttaaaacagttaagagagtccttgtgaggattaagtgagacagtgcctatgaaacaaacactaagtgcagtgtctctggaactgccttactcacaggcttccaccacagccctatgagagctttgccaactctgcggtccatgactgttcccacttttaatgaatcctacctttcgcagaaggctgaaagcagggcagaaaagatctacatttctttggacactgcacttgatagggactcaaagaatgttatatttttaattaatttctttttctcttccgtacaatttctgtctcaacaaaattagaagaattaaatttaaaactagctccaaaagagcagtcgtctttcattttggcagaccttagaatatccccctagcttaataaatctttgttgaatggcttaatgaatgaataaactggttaatgtttaagttaaacctctgaaaagtctccatttaccagatttgagtcactaaatttattgctttcactacttttgaattttgcaaacatgaaattaagttttataattagataaatcaatgtcaacacatatttaaagtttgaggtacactgtcttcctgtggtttcctttcacatgccatcccttaaaatcccagctacacgccttcccattccttcccctttgcctttgttctaatcttccctctctgggggctctctaattcgtcctggaagtttccagtggtcttatagactccatgttcttggaggacaggctgtatgtcagatttaccttttattccgaagaactcggagcatttattttgttaattaaattgcacatatttttaaaagttacgtgttccacagaataaaatactaattgtaaa

SEQ ID NO: 17219 - DNA, 1639 bp, Homo sapiens
gcccagtctggaaagtgaggagcgtctttgcccggccgccatcccatctaggaagtgaggagcgcctcttcccggccgccatcccatctaggaagtgaggagcgtctctgcccggccgcccatcgtctgagatgtggggagtgcctttgccccgccgccccgtctgggatgtgaggagcgcctctgcccggtcgcgaccccgtctgggagctcctgtaggcatctcctgaattaagcaacacagaaaagtcctctgaagtcactgaatcccataaaggctctctacctttagcacaagggaggtcttcaccactggacaaagaaggaacgataaggggtcatcagactggggtttctgagcatggattcaaccatcccagtcttgggtacagaactgacaccaatcaacggacgtgaggagactccttgctacaagcagaccctgagcttcacggggctgacgtgcatcgtttcccttgtcgcgctgacaggaaacgcggttgtgctctggctcctgggctgccgcatgcgcaggaacgctgtctccatctacatcctcaacctggtcgcggccgacttcctcttccttagcggccacattatatgttcgccgttacgcctcatcaatatccgccatcccatctccaaaatcctcagtcctgtgatgacctttccctactttataggcctaagcatgctgagcgccatcagcaccgagcgctgcctgtccatcctgtggcccatctggtaccactgccgccgccccagatacctgtcatcagtcatgtgtgtcctgctctgggccctgtccctgctgcggagtatcctggagtggatgttctgtgacttcctgtttagtggtgctaattctgtttggtgtgaaacgtcagatttcattacaatcgcgtggctggtttttttatgtgtggttctctgtgggtccagcctggtcctgctggtcaggattctctgtggatcccggaagatgccgctgaccaggctgtacgtgaccatcctcctcacagtgctggtcttcctcctctgtggcctgccctttggcattcagtgggccctgttttccaggatccacctggattggaaagtcttattttgtcatgtgcatctagtttccattttcctgtccgctcttaacagcagtgccaaccccatcatttacttcttcgtgggctcctttaggcagcgtcaaaataggcagaacctgaagctggttctccagagggctctgcaggacacgcctgaggtggatgaaggtggagggtggcttcctcaggaaaccctggagctgtcgggaagcagattggagcagtgaggaagaacctctgccctgtcagacaggactttgagagcaatgctgccctgccacccttgacaattatatgcatttttcttagccttctgcctcagaaatgtctcagtggtccctcaaggtcttcgaatagatgtttatctaacctgacagttgcagttttcacccatggaaagcattagtctgacagtacaatgtttggattctccttgatattaccaatacattttccctgttatcttgcactgaatctttcctactgaacactttttctgcacttttcattgtaataaaaggagttgctgtccacaa

SEQ ID NO: 17220 - DNA, 991 bp, Homo sapiens
aaatacctctggcctctgatttgcccatagtcctcatacaggaaataacaagactgtccagcatcttcgtaagcctggattgctcaccagctttcatttcagctcctgtaggcatctcctgaattaagcaacacagaaaagtcctctgaagtcactgaatcccataaaggctctctacctttagcacaagggaggtcttcaccactggacaaagaaggaacgataaggggtcatcagactggggtttctgagcatggattcaaccatcccagtcttgggtacagaactgacaccaatcaacggacgtgaggagactccttgctacaagcagaccctgagcttcacggggctgacgtgcatcgtttcccttgtcgcgctgacaggaaacgcggttgtgctctggctcctgggctgccgcatgcgcaggaacgctgtctccatctacatcctcaacctggtcgcggccgacttcctcttccttagcggccacattatatgttcgccgttacgcctcatcaatatccgccatcccatctccaaaatcctcagtcctgtgatgacctttccctactttataggcctaagcatgctgagcgccatcagcaccgagcgctgcctgtccatcctgtggcccatctggtaccactgccgccgccccagatacctgtcatcagtcatgtgtgtcctgctctgggccctgtccctgctgcggagtatcctggagtggatgttctgtgacttcctgtttagtggtgctaattctgtttggtgtgaaacgtcagatttcattacaatcgcgtggctggtttttttatgtgtggttctctgtgggtccagcctggtcctgctggtcaggattctctgtggatcccggaagatgccgctgaccaggctgtacgtgaccatcctcctcacagtgctggtcttcctcctctgtggcctgccctttggcattcagtgggccctgttttccaggatccacctggattgg

SEQ ID NO: 17221 - DNA, 1444 bp, Homo sapiens
cttcctgtccatggatgaccagtcctagtcacgagtgtgtcacaaccacctctttgtgtatctgaattcctccacctgaaagaaaatttcagacccaggatagattaatcatcgggtccaaagccctggccggatgagtgggggtgttttgatcctaatgttattcccatgtcagcacagaacttgtgtggcagtagagagatgtcaggcttcagagtcaacaagaactggatttcaaactggatttgaggacccccacctttggtaagtgacttattatctgcgagcctctgtttctctcttctttaaatgaggacagtaaatcccatacggcagggtggtggggagaatcagagatgatacagctggtgatcacatctggtttgtgttcccaggggcaccagactagggtttctgagcatggatccaaccgtcccagtcttcggtacaaaactgacaccaatcaacggacgtgaggagactccttgctacaatcagaccctgagcttcacggtgctgacgtgcatcatttcccttgtcggactgacaggaaacgcggttgtgctctggctcctgggctaccgcatgcgcaggaacgctgtctccatctacatcctcaacctggccgcagcagacttcctcttcctcagcttccagattatacgtttgccattacgcctcatcaatatcagccatctcatccgcaaaatcctcgtttctgtgatgacctttccctactttacaggcctgagtatgctgagcgccatcagcaccgagcgctgcctgtctgttctgtggcccatctggtaccgctgccgccgccccacacacctgtcagcggtcgtgtgtgtcctgctctggggcctgtccctgctgtttagtatgctggagtggaggttctgtgacttcctgtttagtggtgctgattctagttggtgtgaaacgtcagatttcatcccagtcgcgtggctgatttttttatgtgtggttctctgtgtttccagcctggtcctgctggtcaggatcctctgtggatcccggaagatgccgctgaccaggctgtacgtgaccatcctgctcacagtgctggtcttcctcctctgcggcctgcccttcggcattctgggggccctaatttacaggatgcacctgaatttggaagtcttatattgtcatgtttatctggtttgcatgtccctgtcctctctaaacagtagtgccaaccccatcatttacttcttcgtgggctcctttaggcagcgtcaaaataggcagaacctgaagctggttctccagagggctctgcaggacaagcctgaggtggataaaggtgaagggcagcttcctgaggaaagcctggagctgtcgggaagcagattggggccatgagggagagcctctgccctgtcagtcagacgggactttgagagcaacactgtcctgc

SEQ ID NO: 17222 - DNA, 5723 bp, Homo sapiens
cggccgcggcggtagcgcggaaaacaatggggccggggcggtggggagaggccgaggcttgaggtaggcagcaagcgccggctgggggtcgggccgagcggggcaggaggaaaacccgccgccgcgcgcgagcccgctccgctgccctcgggggcatggcgcggccgtgaggcggagaggggtagccgcggggagcgaagcccgcagtgccagccggccccgagaggcccggccccgggcccggcccgtgcagcccgcggcccatggtgctgcccacctgccccatggcggagttcgcgctgccgcggcacagcgcggtcatggagcgccttcgccggcgcatcgagctgtgccggcgccaccacagcacctgcgaggcccgctacgaggccgtgtcgcccgagcgcctggagctggagcgccaacacaccttcgccctgcaccagcgctgcatccaggccaaggccaagcgcgccgggaagcacaggcagccgcccgccgccacggccccggcgcccgccgccccggccccgcgcctggacgccgctgacggccccgagcacggccgcccggccacgcatcttcatgatacagttaagaggaatcttgacagcgccacttcccctcagaatggcgatcaacagaatggctacggggacctctttcctgggcataagaagactcgccgggaggcccctctgggagttgccatctcttccaatggactgcctccagcctcccccctcggtcagtctgacaagccttctggagccgacgccctgcagtccagtgggaagcactctctggggctagactctctcaacaaaaagcgtctggctgactccagccttcacttgaatggaggcagtaaccccagtgagtcatttcctctgagcctgaataaagaactgaagcaggagcctgtcgaagacctgccttgcatgatcactgggactgtcggctccatatcgcaaagcaacctcatgccagacctcaaccttaacgagcaggagtggaaggagctcatcgaggagctgaacaggtcggtgcccgatgaagacatgaaggacctgtttaatgaggacttcgaggagaagaaggacccagagtcttctggctctgccacacaaacccccttggcacaggacattaatattaagacggaattctctccagcagcctttgagcaagaacagttaggctctccacaagtgagggccgggtctgcagggcagacctttctggggccttcctctgcccctgtgagtacagattcccccagcctagggggctcccaaaccttattccacacctctggtcagccccgggcggacaatcccagtccaaacctgatgccggcatcagcccaggcccagaacgcacaaagagcccttgcaggtgtggtattgcccagtcagggcccaggaggggcctcagagctgtcctctgcccaccagctccagcagatcgctgccaagcagaagcgcgagcagatgctccagaacccacagcaggccaccccggcaccagccccgggccagatgtccacatggcagcagacggggccctcccacagttccttagatgtcccttaccccatggagaagcctgccagcccttccagctacaagcaagacttcactaactccaaactgctcatgatgcctagtgtgaataagagttcccctcggcccggaggcccctacctccagcccagccatgtgaacctgctgagtcaccagccaccgagtaacttgaatcagaactccgcgaataaccaggggtctgtgctggactacggcaatacaaaacccctttctcattacaaagcggactgtgggcaaggcagcccggggtctggccagagcaagccagccctgatggcttatcttccccagcagctgtcccatataagtcacgagcagaactccctgtttctgatgaagccaaagccaggaaatatgcctttccgatcactggttccacctggccaggagcagaacccttccagtgtccctgtgcaagcccaggctaccagtgttgggacccagccgcctgccgtgtccgtggccagctcccacaacagctccccctatctcagcagccagcaacaggccgctgtaatgaagcagcatcagttgcttttggaccaacagaaacaaagggagcagcagcaaaagcatttacagcaacagcagttccttcagaggcaacagcaccttctcgcggaacaggagaagcaacagtttcagcgccatctgacccgcccaccaccccagtaccaagacccgacacaaggcagcttcccacagcaggttggacagttcacagggtcctctgctgccgtgcccggcatgaacaccttgggtccatccaactccagctgtcctcgagtgttccctcaggctgggaatctgatgccaatgggccctggacatgcttcagtttcctctctccccacaaactcaggccaacaggaccggggtgtggctcagttccctggctcccaaaacatgcctcagagcagcctctatggcatggcttctggcataacccagatagttgcccagcccccgccacaggccaccaatggacatgcccacattccacggcagaccaacgtgggccagaacacctccgtctcagctgcctatgggcagaactctctgggaagctctggcctctcccagcagcacaataaggggaccctgaaccctggtttaacaaagccaccggtcccaagggtgtcaccagccatgggaggccagaattcctcctggcagcatcagggaatgccgaacctcagtggccagaccccagggaacagcaacgtgagtcccttcactgcagcctccagtttccacatgcagcagcaggcccacctgaaaatgtctagcccgcaattctcccaggcagtgcccaacaggcccatggctcccatgagctcagcagctgccgtggggtccttgctacccccagtgagtgcacagcagaggaccagcgcccctgccccagcaccacccccaacagcccctcagcagggcttgcctggcctgagcccagcagggcctgagctgggggccttcagccagagccctgcctcacagatgggcggtcgggcggggctgcactgcacccaggcctaccctgtgcggaccgcgggccaggagctgccttttgcctatagcgggcagccaggtggcagtgggctctctagtgtggctggacacaccgatctgatcgactccctgctgaagaacaggacttcagaggagtggatgagtgatttggacgacctgttagggtctcagtaatggaaggatttgtagtgtttttagtgttcattcatcctatatttttattctcagattcaaagaaagagcaactactttggaccaaaagcccatggcctggggagctgggcaggtagagcccaagctccaggtgaggcctggccctgggcagggtctgtggctgcgcccctcaggccagcagttgaggtccatcgggctggccccagcccatctgctggcatcagtacctggtgttgggacagcaggatagggttctaaaggtggttttctatccaaacgaccaaaaaaccaacagtaacaccagtgaaaccccacactgtcgggcttataaaaatctgtgccatcatggtgattttatccaagactgctccacttaccccagtgctggggacaagtttctgttgaaactttagatagcagaattatttgcaatttgtagcatagaaaagatttttaaatttttttacaaaaggtttttaaacagattagggtaggtgatggtttaaatcaattaagtggcattggaaacctagggtttccttttgattaagagccttttttgtttctgctctttgtcagctttcaggggagaaggaggccactggaaaattatttccctaagtgcaggctgttgactgcgtatgccaaaaagggacaggaggcatgggatagcaggtctggtgacacagctagggtcttcctagcagctcctcctcctccctcccaaggcccccaggaatcccttcctcccatgtcctggcagcaggaccccaggctacatatggaaggtagagatgtgggggtcctgtatcctggagtattatgtctccccaccttctgcagttttctctgaacatgtatgttgcccatggtgggagcgtggtcactgtgcagttgtgcacagatgtctttcctttaccgttggcctttctgtctgcctctccttcctctctgcagcccaaatggaaaacaattatttactccattggagggaaaggaagagtcttagaattcctaagggaaccttagcataaaggttttggggaaggaggccgtaggccggcccggaggaagcaattccacttggtttgacaacttctgccactcccatgtcagatgacttgcacttcttaaagagattgctttataacactaagacatcctttctaaagattcaagtggacttgactaagctgagggtccacgaaatagaatatgacatgtgagctgtttttggaaaacgaagatggagagagcacttccccgtaacgaaagcaaagtggtaagcacagggtgagacccttttacacagaatggtggagagaaaagagaatgctgaaaagtggctcagatgcagagtgttctgtggagaaactgcagccccacttctgtttccctggagtctcccaatggatcattcaggagtgtcctatgtgagaattgagccaaggaaaatactcatgcaaccagcctgagtcgcggtgaggggacgagaggttgtacacacattggtagttattttgcaccagcagtgcctttctcactgggggtacttggaccctcagatcttcttttctaatagccatttgccaccccaagtggtatgtcggccatttctccttaaaacaccttccctacctttcccatgtactcagtttagctctcaaagaaggggtgaatcataaagccagtgaaaatttcaccctctgagggagttccccaatctgaaggggaagagggtgacctcagcggcttttctcccaaaaatcggctgaaggctggttgtggatccttgttcctctcctgaccccatctggctgctgccccgtctcccacccctgtccccggggctcgctggccctgcactccgccttagtcctggggccggcgacacagtgggggctcctcacttgctgcagtgtcatagcaataaaatgtgattcttggggtccccccagggagctgcccatggctttatttatgaacctggttttcgggagtcaggggaggagatgactttgcttctgtgcacagccccgtcttccaggagccacaactcagaagaaaagggtgctcagacttttgttatacacatttgctttgtgtaaataaatgtttacaattttatatgaaagatggaataagcgctagagcttccaactgtatattttttacttttatagattttaaaactatgatcctttatatgtgtgttttgggggagctatgataagttttatggcaaacggttggtattgttaactttttattgtcatcaaaagttcataaaagtcctattaatccccatattcttctactgcccttaactctggtatacaccaaaaagaaatctttactttccttgttttatcattataaaaataaagtattttgctagtatggaaacaa

SEQ ID NO: 17223 - DNA, 2286 bp, Homo sapiens
cgcggaaaacaatggggccggggcggtggggagaggccgaggcttgaggtaggcagcaagcgccggctgggggtcgggccgagcggggcaggaggaaaacccgccgccgcgcgcgagcccgctccgctgccctcgggggcatggcgcggccgtgaggcggagaggggtagccgcggggagcgaagcccgcagtgccagccggccccgagaggcccggccccgggcccggcccgtgcagcccgcggcccatggtgctgcccacctgccccatggcggagttcgcgctgccgcggcacagcgcggtcatggagcgccttcgccggcgcatcgagctgtgccggcgccaccacagcacctgcgaggcccgccgccccggccccgcgcctggacgccgctgacggccccgagcacggccgcccggccacgcatcttcatgatacagttaagaggaatcttgacagcgccacttcccctcagaatggcgatcaacagaatggctacggggacctctttcctgggcataagaagactcgccgggaggcccctctgggagttgccatctcttccaatggactgcctccagcctcccccctcggtcagtctgacaagccttctggagccgacgccctgcagtccagtgggaagcactctctggggctagactctctcaacaaaaagcgtctggctgactccagccttcacttgaatggaggcagtaaccccagtgagtcatttcctctgagcctgaataaagaactgaagcaggagcctgtcgaagacctgccttgcatgatcactgggactgtcggctccatatcgcaaagcaacctcatgccagacctcaaccttaacgagcaggagtggaaggagctcatcgaggagctgaacaggtcggtgcccgatgaagacatgaaggacctgtttaatgaggacttcgaggagaagaaggacccagagtcttctggctctgccacacaaacccccttggcacaggacattaatattaagacggaattctctccagcagcctttgagcaagaacagttaggctctccacaagtgagggccgggtctgcagggcagacctttctggggccttcctctgcccctgtgagtacagattcccccagcctagggggctcccaaaccttattccacacctctggtcagccccgggcggacaatcccagtccaaacctgatgccggcatcagcccaggcccagaacgcacaaagagcccttgcaggtgtggtattgcccagtcagggcccaggaggggcctcagagctgtcctctgcccaccagctccagcagatcgctgccaagcagaagcgcgagcagatgctccagaacccacagcaggccaccccggcaccagccccgggccagatgtccacatggcagcagacggggccctcccacagttccttagatgtcccttaccccatggagaagcctgccagcccttccagctacaagcaagacttcactaactccaaactgctcatgatgcctagtgtgaataagagttcccctcggcccggaggcccctacctccagcccagccatgtgaacctgctgagtcaccagccaccgagtaacttgaatcagaactccgcgaataaccaggggtctgtgctggactacggcaatacaaaacccctttctcattacaaagcggactgtgggcaaggcagcccggggtctggccagagcaagccagccctgatggcttatcttccccagcagctgtcccatataagtcacgagcagaactccctgtttctgatgaagccaaagccaggaaatatgcctttccgatcactggttccacctggccaggagcagaacccttccagtgtccctgtgcaagcccaggctaccagtgttgggacccagccgcctgccgtgtccgtggccagctcccacaacagctccccctatctcagcagccagcaacaggccgctgtaatgaagcagcatcagttgcttttggaccaacagaaacaaagggagcagcagcaaaagcatttacagcaacagcagttccttcagaggcaacagcaccttctcgcggaacaggagaagcaacagtttcagcgccatctgacccgcccaccaccccagtaccaagacccgacacaaggcagcttcccacagcaggttggacagttcacagctcagggtctgagttgtgcactgcctatgatccactccacagaagttctgatttcttctctgtgcaatggttctgccggcctttctgccgcccagaggtcctggtga

SEQ ID NO: 17224 - DNA, 4534 bp, Homo sapiens
ctctctttctccttctctgtctcactctctctctttctctccctctcctatcggagcacaatgaaagcctgtgtatcgccgtgactccgggcgcgagccagtgtcagcaaagcggctaacaacagacgagaaagagaaaggaaaatacaagctactttttttttccatctataaagcggagcaaatacaggagatagaaccagattgcttattgcgagtccagaccctcagatccactggccggggatggaatgtacaaaagtggacagaaaagtggctggacatgactcggtgcaatttgctggaagtttgtaagtttgaccatcgtttgtaaattactctcggaagagtttgtctctcttgatactgtattagaatagagccggggcgaaaggaaagggaggaaaaattaaaagccaaaagacagtctcccttgatttttgcacattttgaacagtgacttaaacatcttctgaaacagcactgttttgttttgttttggttttttatttaacctgaggaaaagtcaaggctgctggttacatagacatggtagaaatgtgtttctctgcagaaacatccccataaagaattgtcggaaacaactaggtgagggggagtcctctctattaatacctctctcaataccttttgctgtgtgtttctgtctcttgctggacaatccctgaattcttgatctaacccccagatcgtgtgtttacaaagtacctagtggctcttgtcagcttggtggaggaaaaaaaatccaccaactctgtccaacttctccagagctgtcaaatgcaattagagtaagttaatcagggtttgtttccaacttatcctccccccagttggtttctattctttctccccaccctctttttactaactcccctcccccacaacttctccacggctcccccacaacctctgaagacctctattcatgtggccctgaacactgagctcacattgtcaaaaacagacttgcctgcaatagccagcagtagcctctttccacctcaccatcccagaggcagcaatcattgtgtccggtaagatgggggacacagcgcccccgcaggcccccgcaggagggctagggggggcctctggggcggggctccttggagggggctcagtcaccccgagagtgcacagtgctatcgtggagcgcctccgggctcggatcgctgtctgccgccaacaccacctgagctgtgaaggacgatatgaacgaggtagggccgagagctcagaccgggaaagagaaagcaccttgcagctcctgagccttgtacagcatggccagggggcaaggaaagctggcaaacacaccaaggccaccgccactgctgccaccactacagcccctccaccgccccctgctgcccctcctgcggcctcccaagcagcagcaacagcagccccaccgcccccaccagactatcaccatcaccaccagcagcacctgctgaacagtagcaataatggtggcagtggtgggataaacggagagcagcagccgcccgcttcaaccccaggggaccagaggaactcagccctgattgcgctccagggttccttgaaaagaaaacaggtagttaacctatctcctgccaacagcaagcgacccaatggctttgtggacaactcatttcttgatatcaaaagaattcgtgttggggagaatctctctgcaggacaaggtggcctccaaataaacaatggacaaagtcagattatgtcagggaccttgcctatgagccaagcacccctgcgaaagactaacactctgccatcccatacacattctcctggcaatggcctgtttaacatgggcttaaaggaggtaaagaaggagccaggagagactctgtcttgcagtaagcacatggatggccaaatgacccaagagaatatttttcctaataggtacggagacgaccctggagaacaactgatggatcctgagctgcaggaactgttcaatgaactgaccaacatatctgtgcctcccatgagtgaccttgaactggagaacatgatcaatgccaccataaagcaggatgacccatttaacattgacttgggtcagcaaagccagaggagcacacctaggccctccttacccatggagaaaatagtgatcaaaagtgaatactcaccgggcttgactcagggcccctcaggctctcctcagctgaggcccccatcagctggccccgcattctccatggccaactctgccctctccacttcgtctccaatcccttcagtccctcagagccaggctcagcctcagacaggctccggagcaagccgggccttgccaagctggcaggaagtatcccatgcccagcagctcaaacagatagctgctaatcgtcagcagcatgcccggatgcagcagcaccagcagcagcaccagcctaccaactggtcagccttgccctcttctgctggaccatcaccaggtccatttgggcaggagaaaatccccagcccttcttttggtcagcagacattcagcccacagagctcccccatgcctggggtagctggcggcagcggccagtcgaaagtaatggctaactacatgtacaaggccggcccctcagcccagggtgggcacctagatgtcctcatgcagcaaaagcctcaggatctcagtcgaagttttattaacaacccgcacccagccatggagccccgtcagggcaacaccaagcctttgtttcattttaactcagatcaagcgaaccagcagatgccttctgttttgccttcccagaacaagccttctctcctacactacacccaacagcaacagcagcaacagcagcagcagcagcagcagcagcagcagcagcagcagcaacagcagcagcagcagcaacagcaacagcaacagcaacagcagagttcaatttcagctcaacaacagcaacagcagcagagctcaatttcagcccaacagcagcagcagcagcaacaacagcagcagcagcagcaacaacaacagcaacaacagcagcagcagcagcagcaacaaccatcttctcagcctgcccaatctctaccaagccagcctttgctaaggtcacctttgccacttcagcaaaagctcctacttcagcaaatgcagaatcagcccattgcaggaatgggataccaagtctcccaacaacagagacaggatcaacactctgtggtaggccagaacacaggccccagtccaagtcctaacccctgctcaaatccaaacactggaagtggttacatgaactcccagcaatcactgttgaatcagcaattgatgggaaagaagcagactctacagaggcagatcatggagcagaaacagcaacttcttctccagcagcagatgctggctgacgcggagaaaattgctccacaagatcagataaaccgacatttgtcaaggccacctccagattataaagaccaaagaagaaatgtgggcaatatgcaaccaactgctcagtattctggtggctcatccacaataagcttaaactctaaccaggctttggcaaacccagtttcaacacacaccattttaactcccaattccagcctcctgtctacttctcacgggacaagaatgccatcattatctacagcagttcagaatatggggatgtatggaaatctgccttgtaatcaacctaacacatacagtgtcacttcaggaatgaatcaattgacccaacagagaaacccaaagcaattgttagcaaatcaaaacaaccctatgatgccacggccacctaccttagggccaagtaataataacaatgtagccacttttggagctggatctgttggtaattcacaacaattgagaccaaatttaacccatagtatggcaagcatgccaccacagagaacatcaaacgtaatgatcacatccaacacaactgcaccaaactgggcctctcaagaaggaacaagcaaacagcaagaagccctgacgtctgcaggagtccgcttccccacaggtacacctgcagcctataccccaaatcagtcactgcaacaggcagtaggtagccagcaattttcccagagggcagtggctcctcctaaccagttaacaccagcagtgcaaatgagacccatgaaccaaatgagccaaacactaaatgggcaaaccatgggtcccctcaggggtctgaatctcagacccaatcagctaagcacacagattttgcctaatttgaatcagtcaggaacagggttgaatcagtcgaggacgggcatcaaccagccaccatccctgacgcccagcaattttccttcacccaaccaaagttccagggcttttcaaggaactgaccacagcagtgacttagcttttgacttcctcagccaacaaaatgataacatgggccctgccctaaacagtgatgctgatttcattgattctttattgaagacagagcctggtaatgatgactggatgaaagacatcaatcttgatgaaatcttggggaacaattcctaa

SEQ ID NO: 17225 - DNA, 7106 bp, Homo sapiens
ctccctctcctatcggagcacaatgaaagcctgtgtatcgccgtgactccgggcgcgagccagtgtcagcaaagcggctaacaacagacgagaaagagaaaggaaaatacaagctactttttttttccatctataaagcggagcaaatacaggagatagaaccagattgcttattgcgagtccagaccctcagatccactggccggggatggaatgtacaaaagtggacagaaaagtggctggacatgactcggtgcaatttgctggaagtttgtaagtttgaccatcgtttgtaaattactctcggaagagtttgtctctcttgatactgtattagaatagagccgggggtgaggaatagaaacgtaagcgggaaagaaaaaaatgtgttgaaggatctctctcagtggctagcgacttaagattgcttttcatttaaggctaggaaaccttagagggagtgaggattttaccggtgattggattagctgaagaaaaaagcatggtccaaaagtccaattactgacattgttaacagttgaaaagctgtctccctcttttgggagaagacaacatcctacagtaccccaaagaggagaaaacaccggagcgaaaggaaagggaggaaaaattaaaagccaaaagacagtctcccttgatttttgcacattttgaacagtgacttaaacatcttctgaaacagcactgttttgttttgttttggttttttatttaacctgaggaaaagtcaaggctgctggttacatagacatggtagaaatgtgtttctctgcagaaacatccccataaagaattgtcggaaacaactaggtgagggggagtcctctctattaatacctctctcaataccttttgctgtgtgtttctgtctcttgctggacaatccctgaattcttgatctaacccccagatcgtgtgtttacaaagtacctagtggctcttgtcagcttggtggaggaaaaaaaatccaccaactctgtccaacttctccagagctgtcaaatgcaattagagtaagttaatcagggtttgtttccaacttatcctccccccagttggtttctattctttctccccaccctctttttactaactcccctcccccacaacttctccacggctcccccacaacctctgaagacctctattcatgtggccctgaacactgagctcacattgtcaaaaacagacttgcctgcaatagccagcagtagcctctttccacctcaccatcccagaggcagcaatcattgtgtccggtaagatgggggacacagcgcccccgcaggcccccgcaggagggctagggggggcctctggggcggggctccttggagggggctcagtcaccccgagagtgcacagtgctatcgtggagcgcctccgggctcggatcgctgtctgccgccaacaccacctgagctgtgaaggacgatatgaacgaggtagggccgagagctcagaccgggaaagagaaagcaccttgcagctcctgagccttgtacagcatggccagggggcaaggaaagctggcaaacacaccaaggccaccgccactgctgccaccactacagcccctccaccgccccctgctgcccctcctgcggcctcccaagcagcagcaacagcagccccaccgcccccaccagactatcaccatcaccaccagcagcacctgctgaacagtagcaataatggtggcagtggtgggataaacggagagcagcagccgcccgcttcaaccccaggggaccagaggaactcagccctgattgcgctccagggttccttgaaaagaaaacaggtagttaacctatctcctgccaacagcaagcgacccaatggctttgtggacaactcatttcttgatatcaaaagaattcgtgttggggagaatctctctgcaggacaaggtggcctccaaataaacaatggacaaagtcagattatgtcagggaccttgcctatgagccaagcacccctgcgaaagactaacactctgccatcccatacacattctcctggcaatggcctgtttaacatgggcttaaaggaggtaaagaaggagccaggagagactctgtcttgcagtaagcacatggatggccaaatgacccaagagaatatttttcctaataggtacggagacgaccctggagaacaactgatggatcctgagctgcaggaactgttcaatgaactgaccaacatatctgtgcctcccatgagtgaccttgaactggagaacatgatcaatgccaccataaagcaggatgacccatttaacattgacttgggtcagcaaagccagaggagcacacctaggccctccttacccatggagaaaatagtgatcaaaagtgaatactcaccgggcttgactcagggcccctcaggctctcctcagctgaggcccccatcagctggccccgcattctccatggccaactctgccctctccacttcgtctccaatcccttcagtccctcagagccaggctcagcctcagacaggctccggagcaagccgggccttgccaagctggcaggaagtatcccatgcccagcagctcaaacagatagctgctaatcgtcagcagcatgcccggatgcagcagcaccagcagcagcaccagcctaccaactggtcagccttgccctcttctgctggaccatcaccaggtccatttgggcaggagaaaatccccagcccttcttttggtcagcagacattcagcccacagagctcccccatgcctggggtagctggcggcagcggccagtcgaaagtaatggctaactacatgtacaaggccggcccctcagcccagggtgggcacctagatgtcctcatgcagcaaaagcctcaggatctcagtcgaagttttattaacaacccgcacccagccatggagccccgtcagggcaacaccaagcctttgtttcattttaactcagatcaagcgaaccagcagatgccttctgttttgccttcccagaacaagccttctctcctacactacacccaacagcaacagcagcaacagcagcagcagcagcagcagcagcagcagcagcagcagcaacagcagcagcagcagcaacagcaacagcaacagcaacagcagagttcaatttcagctcaacaacagcaacagcagcagagctcaatttcagcccaacagcagcagcagcagcaacaacagcagcagcagcagcaacaacaacagcaacaacagcagcagcagcagcagcaacaaccatcttctcagcctgcccaatctctaccaagccagcctttgctaaggtcacctttgccacttcagcaaaagctcctacttcagcaaatgcagaatcagcccattgcaggaatgggataccaagtctcccaacaacagagacaggatcaacactctgtggtaggccagaacacaggccccagtccaagtcctaacccctgctcaaatccaaacactggaagtggttacatgaactcccagcaatcactgttgaatcagcaattgatgggaaagaagcagactctacagaggcagatcatggagcagaaacagcaacttcttctccagcagcagatgctggctgacgcggagaaaattgctccacaagatcagataaaccgacatttgtcaaggccacctccagattataaagaccaaagaagaaatgtgggcaatatgcaaccaactgctcagtattctggtggctcatccacaataagcttaaactctaaccaggctttggcaaacccagtttcaacacacaccattttaactcccaattccagcctcctgtctacttctcacgggacaagaatgccatcattatctacagcagttcagaatatggggatgtatggaaatctgccttgtaatcaacctaacacatacagtgtcacttcaggaatgaatcaattgacccaacagagaaacccaaagcaattgttagcaaatcaaaacaaccctatgatgccacggccacctaccttagggccaagtaataataacaatgtagccacttttggagctggatctgttggtaattcacaacaattgagaccaaatttaacccatagtatggcaagcatgccaccacagagaacatcaaacgtaatgatcacatccaacacaactgcaccaaactgggcctctcaagaaggaacaagcaaacagcaagaagccctgacgtctgcaggagtccgcttccccacaggtacacctgcagcctataccccaaatcagtcactgcaacaggcagtaggtagccagcaattttcccagagggcagtggctcctcctaaccagttaacaccagcagtgcaaatgagacccatgaaccaaatgagccaaacactaaatgggcaaaccatgggtcccctcaggggtctgaatctcagacccaatcagctaagcacacagattttgcctaatttgaatcagtcaggaacagggttgaatcagtcgaggacgggcatcaaccagccaccatccctgacgcccagcaattttccttcacccaaccaaagttccagggcttttcaaggaactgaccacagcagtgacttagcttttgacttcctcagccaacaaaatgataacatgggccctgccctaaacagtgatgctgatttcattgattctttattgaagacagagcctggtaatgatgactggatgaaagacatcaatcttgatgaaatcttggggaacaattcctaaagaagaaagggaagacaatttacaaactccaagcactaaaaggcagtatattacagaaactctgtagaggctgaactgttgatgttcaggtggactacatgaagataacatgcttaaaaatggaaagcagaaagtaactgcagtgatgaacattttggtccaaattcttgttttaaatcttacacctgaaagtaaaatattgggatcacttttccctgtctaaactccaggatacagtatccaatttatccaaacagaactgtggtgtcaatgtgtaattaattgtgtaaaatagccttcccaagtttctttttccctggaaaataaaaaaggtaatagaacttgtagtttatttaaaccccatgtcatgaggaggtactagttccaagcaacaaactccttaatttgctctaatagataggtatggtttaatctttccattgtgtcttttcatttaattttcctgaagcttgcaggatagattgaaatgttataggtttgtttggagtaaccaaacagtatgcaaattaagaaaaagccagagaacctagaaaacatccagtggattacagaatttcttccccatattcactcctcacttttacaattttcccacaatcctctacttcagtgggatgctgtgtctagtgattaaacaaaaatatagagctgtgcaatttgattttggcttccacaacgaatatctgaatccattccaaatgaaattttagatataacaaagacttgtcctaatcatactgaaatattggtgcacacctctctgcattagatttcacttttttaaaaaacccagtggacattgctataaataagatttatttggctacaaataacctgggatgttgcttattatgattgatgcctgctggtttgttcccaagctgagtgaaattgaacctcgtcctccctactcattttgatgactgaggctggtttataagaaaaggaagtttggagaagaaaaccgagattagaaaatatcatgttttggttggagataagaaccagggatggcaagtaccagtgtgtacaaatgtatttcacggagtttgaaggaacgcataatcaagagggaaaacaatttgtccttcattggacgtattatttggatttgggtgagcaacaaaatggaatgtggtctgttaggagcattctgtttgttcttttgtccctgatgtgatgaatcattgccacatgctagatggactcttcatatccaggttttgtccctcagggctgagcactgtattaaagagtttttgttgagtcatttaaccttagtgtccacatccagatcagctgtaaaatggggaagacgtgtgctgatttggaatgaatgcaaaatatcactatcattttcctaattacagaggagcaaaggttatcttcagccctttcagttctatgctcacatattcaaatatcaaatgtaatttagctgaagttatttaataatcaagtctttcaatatctgttcaaagaaaaagaacacactttgaaaattctgcaaagctgtctcccagtctttaaaatgtctggaagcactctccttctttacaataccaacatcactggcccagaatcttccctgtgctagtttgtaaatataaataaattacttgttttgtaaacttttgtaaagaatattttggtagaaatacttcaaacatattctttgggttatatttatacatatgtgaaataaatatactatcaaaaggttatattttatacaaaaagtaaattgctaccttttgtatgctaatatgcaaagttttgtataatatgatggtttatttttagctctacacttaaaccataggtggttgagtgggaacttttgaaaactatcaagaggcttgttagacaaatttatattctgaaacctcaataagaaagcattccaggtttcaatccttgttttttgtcctgctcccaaattcttttttaaacccatagttcttgtgtcttatttgattcttctgctgtgcacattgtattggtccttgttgcatgtagtctactgtgtgttttccgattttataaggcagcatttctccatacaaaaagaaaaaaaatgatgtacatataaacgcttttgttgtatggctcctccatgttactgtatatatctgccagcacttcccagttacactcctgtgagtcagcttatttttaccctaacataaatagtatgttttgtagtagttatcaaatttaagagataaagcaatcagaatgtttggattttcttctatcttaatgtgaatttcataattaatgtctatttattcagctattcattaaaatacaggattctttgggaaaa

SEQ ID NO: 17226 - DNA, 1629 bp, Homo sapiens
ctacaagagactgtgaaaaggaagttggaaggagctcgatcaccacttaatggagaccagcagaatggtgcttgtgatgggaatttttctccgactagcaaacgaattcgaaaggacatttctgcggggatggaagccatcaacaatttgcccagtaacatgccactgccttcagcttctcctcttcaccaacttgacctgaaaccttctttgcccttgcagaacagtggaactcacactcctgggcttctagaagatctaagtaagaatggtaggctccctgagattaaacttcctgtcaacggttgcagtgacctggaggatagcttcaccatcttgcagagcaaagacctcaaacaagaacctctcgatgaccctacttgcatagacacatcagaaacatctctttcaaatcagaacaagctgttctcagacattaatctgaatgatcaggagtggcaagaattaatagatgaattggccaacacggttcctgaggatgacatacaggacctgttcaacgaagactttgaagagaagaaggagccagaattctcgcagccagcaactgagacccctctctcccaggagagtgcgagcgtgaagagcgacccctctcactctcccttcgcacatgtctccatgggatctccccaggcgaggccttcttcttctggtcctcccttttctactgtctccacggccactagtttaccttctgttgccagcactcccgcagctccaaaccctgcaagctcaccagcaaactgtgctgtccagtcccctcaaactccaaaccaagcccacactccaggccaagctccacctcggcctggaaatggttatctcctgaatccggcagcagtgacagtggccggttcagcgtcagggcctgtggctgtgcccagctctgacatgtctccagcagaacagctcaaacagatggctgcacagcagcaacaaagggccaaactcatgcagcagaaacagcaacagcaacagcagcagcagcagcagcagcagcagcagcagcagcagcagcagcagcagcagcagcaacagcactcaaatcagacttcaaattggtctcccttaggacctccctctagtccatatggagcagcttttactgcagaaaaaccaaatagcccaatgatgtacccccaagcctttaacaaccaaaaccctatagtgcctccaatggcaaacaacctgcagaagacaacaatgaataactacctccctcagaatcacatgaatatgatcaatcagcagccaaataacttgggtacaaactccttaaacaaacagcacaatattctgacttatggcaacactaaacccctgacccacttcaatgcagacctgagtcagaggatgacaccaccagtggccaaccccaacaaaaaccccttgatgccgtatatccagcagcagcaacagcagcagcaacagcaacagcagcagcagcagcagcagcagccgccacctccacagctccaggcccccagggcacacctgagcgaagaccagaaacgcctgcttctcatgaagcagaaaggagtgatgaatcagcccatggcttacgctgcacttccatcccacggtcaggagcagcaaccagtcggg

SEQ ID NO: 17227 - DNA, 831 bp, Homo sapiens
atgtctccagcagaacagctcaaacagatggctgcacagcagcaacaaagggccaaactcatgcagcagaaacagcaacagcaacagcagcagcagcagcagcagcagcaacagcactcaaatcagacttcaaattggtctcccttaggacctccctctagtccatatggagcagcttttactgcagaaaaaccaaatagcccaatgatgtacccccaagcctttaacaaccaaaaccctatagtgcctccaatggcaaacaacctgcagaagacaacaatgaataactacctccctcagaatcacatgaatatgatcaatcagcagccaaataacttgggtacaaactccttaaacaaacagcacaatattctgacttatggcaacactaaacccctgacccacttcaatgcagacctgagtcagaggatgacaccaccagtggccaaccccaacaaaaaccccttgatgccgtatatccagcagcagcaacagcagcagcaacagcaacagcagcagcagcagcagcagcagccgccacctccacagctccaggcccccagggcacacctgagcgaagaccagaaacgcctgcttctcatgaagcagaaaggagtgatgaatcagcccatggcttacgctgcacttccatcccacggtcaggtaagtgtgaaagtgacacactcttcgagcagttcttgtggtgcatttgactgtcgatgtgtgatgttctacaagtccactgtagtggggtctaattgcctgcagaaaacctctttacatcctcaggtagtggccaggtttggagtgttctttttccatttctcctaa

SEQ ID NO: 17228 - DNA, 4332 bp, Homo sapiens
actccgctggcatggaggaggaggaggaggtggaggagcgagaggaggaggaggaggcggcggcggcggcggcggcgagcagttgatcattgtgatggtggcaggagcagcggcggcagcggcagcccagccgagcgttaggtgctgctctctgcgcggcgttttgcaaaggacttcaccgatctacttttgcagtcgcctcggactgtccatgtgtttacttcccccagcccgaggattcgatatctaggttcctgtgaaatgcaactgagcagccaaagtactttgagaacacggggcggcataaacaccaaaacttttttgtggaaggaaaatgcaataagcaagcttgccgttttccgatgcggtgtggagtgagtgtgtgtcgcgcgtgtccgcactggaggcatatgcttgtgtgtgtacatggggtgtgtttttcggtatgtagggagaaaatgcttgccaaccaccggaaatctcctggaatttattagaaaataatggattataaaaagaaggcaagcaaggagcggatctccccttgagttgcaacccgatttgctgctggctcagtttgttgtgattctttttgttgataggtgtctgatggtattccgataacgttccccccttttcttccccttgagcttttacagtttaaaaaaaggaaacaaaaaccaccccaaaatctccccccccgtttttttcgccccgtcgggatcgccgtttccatccatgtgcttgcgtctcccccgcgttccacttaaactattttaatccttggacccaaggaggaggctgataggggggtggataaaaaaagttcttccaaaatagtgtgcccggggagcaggatgggggatttcgcagcccccgctgctgccgcgaatggcagtagtatttgcatcaacagtagcctgaacagcagcctcggcggggccgggatcggtgtgaataatactcccaatagtactcccgctgctccgagtagcaatcacccggcagccggtggatgcggcggctccgggggccccggcggcggttcggcggccgttcccaagcacagcaccgtggtggagcggctccgccagcgcatcgagggctgccgtcggcaccacgtcaactgcgagaacaggtaccagcaggctcaggtggagcagctggagctggagcgccgggacaccgtgagcctctaccagcggaccctggagcagagggccaagaaatcgggcgccggcaccggcaaacagcagcacccgagcaaaccccagcaagatgcggaggctgcctcggcggagcagaggaaccacacgctgatcatgctacaagagactgtgaaaaggaagttggaaggagctcgatcaccacttaatggagaccagcagaatggtgcttgtgatgggaatttttctccgactagcaaacgaattcgaaaggacatttctgcggggatggaagccatcaacaatttgcccagtaacatgccactgccttcagcttctcctcttcaccaacttgacctgaaaccttctttgcccttgcagaacagtggaactcacactcctgggcttctagaagatctaagtaagaatggtaggctccctgagattaaacttcctgtcaacggttgcagtgacctggaggatagcttcaccatcttgcagagcaaagacctcaaacaagaacctctcgatgaccctacttgcatagacacatcagaaacatctctttcaaatcagaacaagctgttctcagacattaatctgaatgatcaggagtggcaagaattaatagatgaattggccaacacggttcctgaggatgacatacaggacctgttcaacgaagactttgaagagaagaaggagccagaattctcgcagccagcaactgagacccctctctcccaggagagtgcgagcgtgaagagcgacccctctcactctcccttcgcacatgtctccatgggatctccccaggcgaggccttcttcttctggtcctcccttttctactgtctccacggccactagtttaccttctgttgccagcactcccgcagctccaaaccctgcaagctcaccagcaaactgtgctgtccagtcccctcaaactccaaaccaagcccacactccaggccaagctccacctcggcctggaaatggttatctcctgaatccggcagcagtgacagtggccggttcagcgtcagggcctgtggctgtgcccagctctgacatgtctccagcagaacagctcaaacagatggctgcacagcagcaacaaagggccaaactcatgcagcagaaacagcaacagcaacagcagcagcagcagcagcagcagcagcagcagcagcagcagcagcagcagcagcagcaacagcactcaaatcagacttcaaattggtctcccttaggacctccctctagtccatatggagcagcttttactgcagaaaaaccaaatagcccaatgatgtacccccaagcctttaacaaccaaaaccctatagtgcctccaatggcaaacaacctgcagaagacaacaatgaataactacctccctcagaatcacatgaatatgatcaatcagcagccaaataacttgggtacaaactccttaaacaaacagcacaatattctgacttatggcaacactaaacccctgacccacttcaatgcagacctgagtcagaggatgacaccaccagtggccaaccccaacaaaaaccccttgatgccgtatatccagcagcagcaacagcagcagcaacagcaacagcagcagcagcagcagcagcagccgccacctccacagctccaggcccccagggcacacctgagcgaagaccagaaacgcctgcttctcatgaagcagaaaggagtgatgaatcagcccatggcttacgctgcacttccatcccacggtcaggagcagcatccagttggacttccccgaaccacaggccccatgcagtcctccgtgcccccaggctcaggtggcatggtctcaggagccagtcccgcaggccccggcttcctgggcagccagccccaagcagccatcatgaagcagatgctcattgatcagcgggcccagttgatagagcagcagaagcaacagttcctgcgggagcaaaggcagcagcagcagcagcagcagcagcagattttggcggaacagcagttgcagcaatcacatctaccccggcagcacctccagccacagcggaatccatacccagtgcagcaggtcaatcagtttcaaggttctccccaggatatagcagccgtaagaagccaagcagccctccagagcatgcgaacgtcacggctgatggcacagaacgcaggcatgatgggaataggaccctcccagaaccctgggacgatggccaccgcagctgcgcagtcggagatgggactggccccttatagcaccacgcctaccagccaaccaggaatgtacaatatgagcacaggcatgacccaaatgttgcagcatccaaaccaaagtggcatgagcatcacacataaccaagcccagggaccgaggcaacctgcctctgggcagggggttggaatggtgagtggctttggtcagagcatgctggtgaactcagccattacccagcaacatccacagatgaaagggccagtaggccaggccttgcctaggccccaagcccctccaaggctgcagagccttatgggaacagtccagcaaggagcacaaagctggcaacagaggagcttgcagggcatgcctgggaggactagtggagaattgggaccattcaacaatggcgccagctaccctcttcaagctgggcagccgagactgaccaagcagcacttcccacagggactgagccagtcagtcgtggatgctaacacgggcacagtgaggaccctcaacccagctgccatgggtcggcagatgatgccatcgctcccggggcagcaaggcaccagccaggcgaggccaatggtcatgtctggcctgagccagggagtcccaggcatgccagcgttcagccagcccccagcacagcagcagatacccagtggcagctttgctccaagcagccagagccaagcctatgagcggaatgcccctcaggacgtgtcatacaattacagtggcgacggagctgggggttccttccctggcctcccggacggtgcagaccttgtggactccatcatcaaaggcgggccaggggacgagtggatgcaggagcttgatgaattgtttggtaacccctaatcaagagaggccccaagatccacaactcgagtggttaaagcttaaaaagtgaaaaaga

SEQ ID NO: 17229 - DNA, 1381 bp, Homo sapiens
gagcagcatccagttggacttccccgaaccacaggccccatgcagtcctccgtgcccccaggctcaggtggcatggtctcaggagccagtcccgcaggccccggcttcctgggcagccagccccaagcagccatcatgaagcagatgctcattgatcagcgggcccagttgatagagcagcagaagcaacagttcctgcgggagcaaaggcagcagcagcagcagcagcagcagcagattttggcggaacagcagttgcagcaatcacatctaccccggcagcacctccagccacagcggaatccatacccagtgcagcaggtcaatcagtttcaaggttctccccaggatatagcagccgtaagaagccaagcagccctccagagcatgcgaacgtcacggctgatggcacagaacgcaggcatgatgggaataggaccctcccagaaccctgggacgatggccaccgcagctgcgcagtcggagatgggactggccccttatagcaccacgcctaccagccaaccaggaatgtacaatatgagcacaggcatgacccaaatgttgcagcatccaaaccaaagtggcatgagcatcacacataaccaagcccagggaccgaggcaacctgcctctgggcagggggttggaatggtgagtggctttggtcagagcatgctggtgaactcagccattacccagcaacatccacagatgaaagggccagtaggccaggccttgcctaggccccaagcccctccaaggctgcagagccttatgggaacagtccagcaaggagcacaaagctggcaacagaggagcttgcagggcatgcctgggaggactagtggagaattgggaccattcaacaatggcgccagctaccctcttcaagctgggcagccgagactgaccaagcagcacttcccacagggactgagccagtcagtcgtggatgctaacacgggcacagtgaggaccctcaacccagctgccatgggtcggcagatgatgccatcgctcccggggcagcaaggcaccagccaggcgaggccaatggtcatgtctggcctgagccagggagtcccaggcatgccagcgttcagccagcccccagcacagcagcagatacccagtggcagctttgctccaagcagccagagccaagcctatgagcggaatgcccctcaggacgtgtcatacaattacagtggcgacggagctgggggttccttccctggcctcccggacggtgcagaccttgtggactccatcatcaaaggcgggccaggggacgagtggatgcaggagcttgatgaattgtttggtaacccctaatcaagagaggccccaagatccacaactcgagtggttaaagctt

SEQ ID NO: 17230 - DNA, 4607 bp, Homo sapiens
ccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaaagaagccctcgtggatggaggaagaagatttatcttttctctacaagagcagcccaggaagaaagcatcagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacagggctgttgccatctgtttgcatggacttctgcagctagctcggtgaagccccagcatcaacacgggaactctttcactagcaggcaagatcctcagcctggagacgtgtcaccgtctaacattactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagctgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggagaaaagtgcc

SEQ ID NO: 17231 - DNA, 591 bp, Homo sapiens
aatcaagcctgggcaatggcgggcgcccctcccccagcctcgctgctgccttgcagtttgatctgactgctgtgctagcaatcagcgagactccgtgggcgtaggaccctctgagccagccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaaagaagccctcgtggatggaggaagaagatttatcttttctctacaagagcagcccaggaagaaagcatcagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatga

SEQ ID NO: 17232 - DNA, 4854 bp, Homo sapiens
ggcgcggagccgggcggtgggaatggagcgagcagattgaggccgccactgcagcgccgccagcatgaacttggccgcgagctgaagcggccggcggcgggcgggcgcgggggcaccggccgctagccagggggtgatctgcaacagggctgggttccttggcggccgcctgagtccaggctgcccgcgccggcggccgcccgcccctcggacactgcccccgccgccgccggagctctgcagcacgccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaaagaagccctcgtggatggaggaagaagatttatcttttctctacaagagcagcccaggaagaaagcatcagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacagggctgttgccatctgtttgcatggacttctgcagctagctcggtgaagccccagcatcaacacgggaactctttcactagcaggcaagatcctcagcctggagacgtgtcaccgtctaacattactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagctgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggagaaaagtgcc

SEQ ID NO: 17233 - DNA, 4532 bp, Homo sapiens
ccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacagggctgttgccatctgtttgcatggacttctgcagctagctcggtgaagccccagcatcaacacgggaactctttcactagcaggcaagatcctcagcctggagacgtgtcaccgtctaacattactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagctgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggagaaaagtgcc

SEQ ID NO: 17234 - DNA, 3224 bp, Homo sapiens
gatctgcaacagggctgggttccttggcggccgcctgagtccaggctgcccgcgccggcggccgcccgcccctcggacactgcccccgccgccgccggagctctgcagcacgccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagt

SEQ ID NO: 17235 - DNA, 2434 bp, Homo sapiens
accagatgtgttggtgacaggttgctactcagaggtgcggacaggagctgagcgctgctgctgtcggagcagacgcggcgttcccgggttgtgctcagcccctgcagctgccatcggctggagaagtccagcgcaccgcctaggcaagccagctgacgccgggggcacagaccaccctccactgagtgcggagcagccaagggaaagaagccctcgtggatggaggaagaagatttatcttttctctacaagagcagcccaggaagaaagcatcagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacagggctgttgccatctgtttgcatggacttctgcagctagctcggtgaagccccagcatcaacacgggaactctttcactagcaggcaagatcctcagcctggagacgtgtcaccgtctaacattactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactca

SEQ ID NO: 17236 - DNA, 1051 bp, Homo sapiens
ctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacagactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagact

SEQ ID NO: 17237 - DNA, 2309 bp, Homo sapiens
gagatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgt

SEQ ID NO: 17238 - DNA, 2232 bp, Homo sapiens
gaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaat

SEQ ID NO: 17239 - DNA, 2271 bp, Homo sapiens
aacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgaggaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgt

SEQ ID NO: 17240 - DNA, 2125 bp, Homo sapiens
acaacccggcgatcgaaaagattcttaggaacgccgtaccagccgcgtctctcaggacagcaggcccctgtccttctgtcgggcgccgctcagccgtgccctccgcccctcagagtgatttgccccggatcaaaacggagattgaggccttgaagaacctgagacatcagcatatatgtcaactctaccatgtgctagagacagccaacaaaatattcatggttcttgaggaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatat

SEQ ID NO: 17241 - DNA, 2268 bp, Homo sapiens
agatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacagagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagagacggagtttcgctcttgttgcccaggctggagtgcaatggtgtgatcttggctcactgcaacctctgcctcccgagttcaagcgattctcctgcctcagcctcccgaattgctggaattacaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattgg

SEQ ID NO: 17242 - DNA, 2291 bp, Homo sapiens
aaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctg

SEQ ID NO: 17243 - DNA, 2347 bp, Homo sapiens
aaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacagagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaat

SEQ ID NO: 17244 - DNA, 2236 bp, Homo sapiens
aacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatat

SEQ ID NO: 17245 - DNA, 3832 bp, Homo sapiens
acaaccgtgccggctgctgcccgtgctgccagaactatgagggtcctctctggcactagcctcatgctctgcagcctgctgctgctgctccaggccctgtgcagccctggcctcgccccccagtccagaggccatctctgccggacgcggcccacagacctggtgtttgttgtcgacagctctcgcagcgttcggcctgttgaatttgagaaagtgaaggtattcctgtcccaggtcatcgagtcgctggacgtggggcccaatgccacccgggtgggcatggtcaactatgccagcaccgtgaagcaggagttctcgctgcgggctcatgtctccaaggccgcactgctgcaggctgtgcgccgtatccagccgctgtccacaggcaccatgaccggcctggccatccagttcgctatcaccaaagccttcggcgatgcagagggtggtcgttccaggtcccctgacatcagcaaggtggtcatcgtggtgacagacgggaggccccaggacagcgtgcaggacgtgtctgcgcgggcccgggccagcggcgtcgagctgttcgccatcggagtgggcagcgtggacaaggccacgctgcggcagatcgccagcgagccgcaggacgaacacgtcgattacgtggagagctacagcgtcatcgagaagctgtccaggaagttccaggaggccttctgcgtggtgtcagacctgtgcgccacaggggaccatgactgtgagcaggtgtgcatcagctcccccggttcctacacctgcgcctgccacgagggcttcactctgaacagcgacggcaagacctgcaatgtctgcagtggtggtggtggcagctcggccactgacctggtcttcctcattgacggatccaagagtgtgaggccagagaactttgagctggtgaagaagttcatcagtcagatcgtggatacgctggacgtgtcagacaagctggcccaggtggggctggtgcagtactcaagctctgtgcgccaggagttccccctgggtcgcttccacaccaagaaggacatcaaggcggctgtgcggaatatgtcctacatggagaagggcacaatgactggggctgctctcaagtacctcattgacaattccttcactgtgtccagtggggctaggcccggggcccagaaggtgggcattgtcttcactgatggccggagccaggactacattaatgatgctgccaagaaggccaaagacctcggctttaagatgtttgctgtgggtgtgggcaatgccgtggaggatgagctgagggaaatagcctcagagcctgtggcagagcactacttctacacggctgacttcaagaccatcaaccagataggcaagaagttgcagaagaagatctgtgtggaggaagacccgtgtgcctgcgagtccctggtgaaattccaagccaaagtggaggggctgctgcaggccctgaccaggaaactggaagctgtgagtaagcggctggccatcctggagaacacagttgtctaaggctgcctgtcaccactgtggcctctccaagcgtcctgcacgtgtccgccgtagctttaccattttagtgagggaagccagcccgggggtgggagggggtgtgtctgggtgtgcctattgagagcgtgtaatggcgtttgggagctcgtgtgtgtatgtgtgcgtgtgtgtatgtgtgcatgtgtgtgtgtgtgtgtgtgtgtgcacgtgcgcctgagggtgggcatgagtcttgccagaatgtgagtgtgagagtgataatgcaggggtgagtgtgagagggactgcgtttgcatttttataatcaaaagcttaatatattcccatcttttttagttaaccctttcttgactctgagtgctgtgaatttctttactgatttctctattctccggtgagaaacaattaaatgtgatttaacgtaagcagtgaatggggctagaggcagtgtggttatttggggaccagggaaaaggatggatgaagatgtggtgggaggggatggttggaaggatggtaacagtggtggtgacagtgatgacagtgaccacaccaaaaccagctggtgtttgtcctgccttttcagttacatattcatttagttgacctcatttcacttccagtaaccttacccagaaaagactcaaattatccccattacaaatgggaaagctgagagtctaaatgatgaaatgacttgctcagcagtgggtcgctgagagacaggacttgaatctaggactgaagaacatcaaaagaaaaaggcttcagagaaaaagggcaatgacaccagataggactcatttgttcattcattcattcgttcactcattcgttcaggtatcatgtacttacagggcaatggcggtggggggggatggtgctgtatgagacagacgtagttcctgccctaagagacatacagttgagcagggtgctcatgtcacccccaccagccagagggaccagccagaggaaaagagagtgggtttaggtcgtaccaggggtttgtgcctcctcttgatacctgggagcccacggggtgagtgtgtgtgtgagatgatgggaagggctccagcctgggcctgggctgccctaggtgcctctcccctcccgcccccaacatgccctgttggagttctgtttgtttcctgtgcacaggcggcatcacccccaacccaaagtccccaacgcagatggcagcagccccacctcagagactgcacaagagaaagactcctggccccatgttcccttcctccagccctatgtggggtctgcaggtcacaccctgagatctcggccacctcccccaggcccctgttggaccagtgctgctccggaatctccatctctgtcctctcagagggggagctttggtgattttctgaacctattcttgtttaatggagcatttttagtgttactactagattcacacttgagagcatgtctaaaaggcttttacaagaagctcagaccacaccgaaagatcttcctcggaggcagttcaaagaggcagaataacaacacgaacggtacccaagagctacatcagtacaacagcacaaatacacaagcgcgacttaactggggcacagccaccctcgcccccatgacctgactccacctcctacacagttcaccaaaccctttctctctgtccgtccctggggcaggagtttttctgctgtccaaggaggctccttgacacagccacctgagaagttatgactctgctcattcttcctttcttctgagattatccactcccctctcctccccacacaggtggggagggggagaggcagccatgttgatatggactgagaaggctcagcagtgtgtccccaaggaggaggagagggtcattagcggacgccatggcctgggagctggcgggcagaagcaacagatgtccctgatgagtggagtcagagatggggtggaagccctgcctgggaataggacctcgttcttccctgcccggtgggtggagtagtggcaggaccttgtcaccaggctctgatgaaggcagggaccagcttcttgggatctttcaatcccaaactcttgcccttcactcatcgcagttctccccacggctactccaggtcctcttgaaatccgtcctctccatggacttcccacatccctctctgctctaggtttgattaacagaaggttgtaaatgaaaaccagcatctcccgagggcagccatggtctactgacagatggcaagttactttgtaacctgtaattttgtttttttgaattttgtataaataaacaggactaaactaa

SEQ ID NO: 17246 - DNA, 4109 bp, Homo sapiens
gcgagcgaagggagcgctctgggatgggacttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccatatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgtttactagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagagaatggtattcagtgcaaaaattcttagtttaactttaaatggaagatatgtatgtatgagaaatggccaacatgcctatgaaaaaaatgctgaatctcatcagtaatcaggaaaatgcaggttaaaacaataccatttttcacccatcagcttagcaaaaatgagtatattttttaacaagtgttggtaaggatgtggaaatgtgaggttcttgtagtaagaatgcaaatggcactctttgtagagtaagtctgttgacatctcataaaactgaaaatgcacacaaccctgtaaatctagcaactgcactcagttgatttcagcccatacatacaaagagacctgcataagaatgttactaggctttgtaaaagcaaaaaataaggaacaacttaaacatcatcagaaggggaactgataaactctggtgtaatccataccacagaaatacaacaccgcatgtacaggaatgtgctacatctatacaaataaatggtcaaactc

SEQ ID NO: 17247 - DNA, 2985 bp, Homo sapiens
gcgagcgaagggagcgctctgggatgggacttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccatatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgctatttactagaagaaatgacacagagaatggaagccctggaaaatcgcctgagatacagatga

SEQ ID NO: 17248 - DNA, 600 bp, Homo sapiens
aggtgatggctggtgggttcagagtaattaagactgatggataactgcagagaggaaatctagttttcagggcaaacagatgcgtccaagagagagcccacacacgtggttggatgcagctggagatggagaattccagttcaaggaaaaggcctgggcagtatgtgtttggtggtggtcgttgaccctgaaaatagatggaatcttggagggagaaagcgagtgtggaaagtgaagtccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacct

SEQ ID NO: 17249 - DNA, 3495 bp, Homo sapiens
gaactctgaaaaggcggggcagcgggcctgcagctcctggagttcagggagacccggaaatctcaccctgccctcttcttgtgttgtgtttgtcacagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccatatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagag

SEQ ID NO: 17250 - DNA, 3554 bp, Homo sapiens
gatgcccgcctgggctcaggcacggacggagtggagccaggtggcagcaggcagggcgcgccgccagagtgcccagctcccggggctgcccacagggtggggccgccctcgccgccgctccctctccgcgccttccccatccccaaagaggacacccctccttccgcccggcccgctccccacccccgccgcggcaccgcctccccagccgcccgcccttgcccagcgcctcccaggcagccagcgagcgaagggagcgctctgggatgggacttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccatatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatact

SEQ ID NO: 17251 - DNA, 2728 bp, Homo sapiens
agctggggctccgtcctcgcctcccacgagcgatccccgaggagagccgcggccctcggcgaggcgaagaggccgacgaggaagacccgggtgcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagagaa

SEQ ID NO: 17252 - DNA, 3449 bp, Homo sapiens
acttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccatatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcag

SEQ ID NO: 17253 - DNA, 2524 bp, Homo sapiens
aaatccgagcctcgcgtgggctcctggcccccgacggacaccaccaggcccacggagcccaccatgccgcgcccggcccccgcgcgccgcctcccgggactcctcctgctgctctggccgctgctgctgctgccctccgccgcccccgaccccgtggcccgcccgggcttccggaggctggagacccgaggtcccgggggcagccctggacgccgcccctctcctgcggctcccgacggcgcgcccgcttccgggaccagcgagcctggccgcgcccgcggtgcaggtgtttgcaagagcagacccttggacctggtgtttatcattgatagttctcgtagcgtacggcccctggaattcaccaaagtgaaaacttttgtctcccggataatcgacactctggacattgggccagccgacacgcgggtggcagtggtgaactatgctagcactgtgaagatcgagttccaactccaggcctacacagataagcagtccctgaagcaggccgtgggtcgaatcacacccttgtcaacaggcaccatgtcaggcctagccatccagacagcaatggacgaagccttcacagtggaggcaggggctcgagagccctcttctaacatccctaaggtggccatcattgttacagatgggaggccccaggaccaggtgaatgaggtggcggctcgggcccaagcatctggtattgagctctatgctgtgggcgtggaccgggcagacatggcgtccctcaagatgatggccagtgagcccctagaggagcatgttttctacgtggagacctatggggtcattgagaaactttcctctagattccaggaaaccttctgtgcgctggacccctgtgtgcttggaacacaccagtgccagcacgtctgcatcagtgatggggaaggcaagcaccactgtgagtgtagccaaggatacaccttgaatgccgacaagaaaacgtgttcagctcttgataggtgtgctcttaacacccacggatgtgagcacatctgtgtgaatgacagaagtggctcttatcattgtgagtgctatgaaggttataccttgaatgaagacaggaaaacttgttcagctcaagataaatgtgctttgggtacccatgggtgtcagcacatttgtgtgaatgacagaacagggtcccatcattgtgaatgctatgagggctacactctgaatgcagataaaaaaacatgttcagtccgtgacaagtgtgccctaggctctcatggttgccagcacatttgtgtgagtgatggggccgcatcctaccactgtgattgctatcctggctacaccttaaatgaggacaagaaaacatgttcagccactgaggaagcacgaagacttgtttccactgaagatgcttgtggatgtgaagctacactggcattccaggacaaggtcagctcgtatcttcaaagactgaacactaaacttgatgacattttggagaagttgaaaataaatgaatatggacaaatacatcgttaaattgctccaatttctcacctgaaaatgtggacagcttggtgtacttaatactcatgcattcttttgcacacctgttattgccaatgttcctgctaataatttgccattatctgtattaatgcttgaatattactggataaattgtatgaagatcttctgcagaatcagcatgattcttccaaggaaatacatatgcagatacttattaagagcaaactttagtgtctctaagttatgactgtgaaatgattggtaggaaatagaatgaaaagtttagtgtttctttatctactaattgagccatttaatttttaaatgtttatattagataaccatattcacaatggaaactttaggtctagtttcttttgatagtatttataatataaatcaatcttattactgagagtgcaaattgtacaaggtatttacacatacaacttcatataactgagatgaatgtaattttgaactgtttaacactttttgttttttgcttattttgttggagtattattgaagatgtgatcaatagattgtaatacacatatctaaaaatagttaacacagatcaagtgaacattacattgccatttttaattcattctggtctttgaaagaaatgtactactaaagagcactagttgtgaatttagggtgttaaactttttaccaagtacaaaaatcccaaattcactttattattttgcttcaggatccaagtgacaaagttatatatttataaaattgctataaatcgacaaaatctaatgttgtctttttaatgttagtgatccacctgcctcagcctcccaaagtgctgggattacaggcttgaaagtctaacttttttttacttatatatttgatacatataattcttttggctttgaaacttgcaactttgagaacaaaacagtcctttaaattttgcactgctcaattctgtttttcgtttgcattgtctttaatataataaaagttattacctttacatatt

SEQ ID NO: 17254 - DNA, 1443 bp, Homo sapiens
cccgacggacaccaccaggcccacggagcccaccatgccgcgcccggcccccgcgcgccgcctcccgggactcctcctgctgctctggccgctgctgctgctgccctccgccgcccccgaccccgtggcccgcccgggcttccggaggctggagacccgaggtcccgggggcagccctggacgccgcccctctcctgcggctcccgacggcgcgcccgcttccgggaccagcgagcctggccgcgcccgcggtgcaggtgtttgcaagagcagacccttggacctggtgtttatcattgatagttctcgtagcgtacggcccctggaattcaccaaagtgaaaacttttgtctcccggataatcgacactctggacattgggccagccgacacgcgggtggcagtggtgaactatgctagcactgtgaagatcgagttccaactccaggcctacacagataagcagtccctgaagcaggccgtgggtcgaatcacacccttgtcaacaggcaccatgtcaggcctagccatccagacagcaatggacgaagccttcacagtggaggcaggggctcgagagccctcttctaacatccctaaggtggccatcattgttacagatgggaggccccaggaccaggtgaatgaggtggcggctcgggcccaagcatctggtattgagctctatgctgtgggcgtggaccgggcagacatggcgtccctcaagatgatggccagtgagcccctagaggagcatgttttctacgtggagacctatggggtcattgagaaactttcctctagattccaggaaaccttctgtgctcttgataggtgtgctcttaacacccacggatgtgagcacatctgtgtgaatgacagaagtggctcttatcattgtgagtgctatgaaggttataccttgaatgaagacaggaaaacttgttcagctcaagataaatgtgctttgggtacccatgggtgtcagcacatttgtgtgaatgacagaacagggtcccatcattgtgaatgctatgagggctacactctgaatgcagataaaaaaacatgttcagtccgtgacaagtgtgccctaggctctcatggttgccagcacatttgtgtgagtgatggggccgcatcctaccactgtgattgctatcctggctacaccttaaatgaggacaagaaaacatgttcagccactgaggaagcacgaagacttgtttccactgaagatgcttgtggatgtgaagctacactggcattccaggacaaggtcagctcgtatcttcaaagactgaacactaaacttgatgacattttggagaagttgaaaataaatgaatatggacaaatacatcgttaaattgctccaatttctcacctgaaaatgtggacagcttggtgtacttaatactcatgcattcttttgcacacctg

SEQ ID NO: 17255 - DNA, 2056 bp, Homo sapiens
aaatgcggccgttgcctctgtgtgctccagctgcctggcagtccccacctagggcacgctgccacgccgccgttacctggtccaagtgcccgggaggctccgcctgtcggcttcgctctgcagctgcatctctgatctgtcctgcaggctcaggctctgacacctccattctctgtccccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgggaaggaccagtgtgctgaggggggacatggttgccagcaccaatgtgtcaatgcctgggccatgttccactgcacctgcaacccaggctacaagctagcagcagataacaagagctgtttggccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtga

SEQ ID NO: 17256 - DNA, 2253 bp, Homo sapiens
aaatgcggccgttgcctctgtgtgctccagctgcctggcagtccccacctagggcacgctgccacgccgccgttacctggtccaagtgcccgggaggctccgcctgtcggcttcgctctgcagctgcatctctgatctgtcctgcaggctcaggctctgacacctccattctctgtccccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacgg

SEQ ID NO: 17257 - DNA, 2007 bp, Homo sapiens
aaatgcggccgttgcctctgtgtgctccagctgcctggcagtccccacctagggcacgctgccacgccgccgttacctggtccaagtgcccgggaggctccgcctgtcggcttcgctctgcagctgcatctctgatctgtcctgcaggctcaggctctgacacctccattctctgtccccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacgg

SEQ ID NO: 17258 - DNA, 2130 bp, Homo sapiens
aaatgcggccgttgcctctgtgtgctccagctgcctggcagtccccacctagggcacgctgccacgccgccgttacctggtccaagtgcccgggaggctccgcctgtcggcttcgctctgcagctgcatctctgatctgtcctgcaggctcaggctctgacacctccattctctgtccccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacgg

SEQ ID NO: 17259 - DNA, 1486 bp, Homo sapiens
aaatgcggccgttgcctctgtgtgctccagctgcctggcagtccccacctagggcacgctgccacgccgccgttacctggtccaagtgcccgggaggctccgcctgtcggcttcgctctgcagctgcatctctgatctgtcctgcaggctcaggctctgacacctccattctctgtccccaagcgccatgagaggccttctttgctggcccgtgttgctgctccttcttcagccctgggaaacccagctccagttgacagggaaggaccagtgtgctgaggggggacatggttgccagcaccaatgtgtcaatgcctgggccatgttccactgcacctgcaacccaggctacaagctagcagcagataacaagagctgtttggccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtga

SEQ ID NO: 17260 - DNA, 1630 bp, Homo sapiens
ccaagcgccatgagaggccttctttgctggcccgtgttgctgctccttcttcagccctgggaaacccagctccagttgacagggaaggaccagtgtgctgaggggggacatggttgccagcaccaatgtgtcaatgcctgggccatgttccactgcacctgcaacccaggctacaagctagcagcagataacaagagctgtttggccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacgggg

SEQ ID NO: 17261 - DNA, 2200 bp, Homo sapiens
ccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgggaaggaccagtgtgctgaggggggacatggttgccagcaccaatgtgtcaatgcctgggccatgttccactgcacctgcaacccaggctacaagctagcagcagataacaagagctgtttggccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacgggg

SEQ ID NO: 17262 - DNA, 2282 bp, Homo sapiens
agtgtggctgccccggtctccccagtctcccgctgtagctgaattccagcctggcccgcagctagccctgtctgcagctccaagcgtgctgcctggcagtccccacctagggcacgctgccacgccgccgttacctggtccaagtgcccgggaggctccgcctgtcggcttcgctctgcagctgcatctctgatctgtcctgcaggctcaggctctgacacctccattctctgtccccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttctt

SEQ ID NO: 17263 - DNA, 2129 bp, Homo sapiens
gcgtcccgctcgctgggagagaggtacctctccttttccctctccctttccctaagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaagcgtcgttttccagggagtatggaaggttttgtcactctagatgaggttggtgatgaggaagattcggaacttcagaaacttcgtaaatcgggcatggcatttaaatctggtgacaaaaatgatgatggtttggttgaaattaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaacc

SEQ ID NO: 17264 - DNA, 4015 bp, Homo sapiens
ctttcccctccggcctctgccggtgctgctgcgccctgcggagctccgaacacgtgcgcagaggctggctgtggcagatgcaactgcaggatgacttgaaagtagggcatccttcacccatctgaagggaggaaatagtggcaggtgacagtctgcatgtgcagttttcagatgccttcacctgaatgacatctacctccatcaggaccccagatgtctgacagccctgtgtgacaccaagataagtaacagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaacc

SEQ ID NO: 17265 - DNA, 4843 bp, Homo sapiens
gtgggggcgagctctctcgcgagagtgggtttgttcttgggctgcagccgctgccgccgcttctcgccagcgccgttgctgcgggggattgtgggagtctccgcgtcccgctcgctgggagagaggtacctctccttttccctctccctttccctaagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgtaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgca

SEQ ID NO: 17266 - DNA, 589 bp, Homo sapiens
gtttcattgcagagaggctggctgtggcagatgcaactgcaggtgccgtcatttaatttcccagacacttgacctccttctgatttgtgtactccctccaaggctgagttgcaagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctca

SEQ ID NO: 17267 - DNA, 2664 bp, Homo sapiens
gttgctgcgggggattgtgggagtctccgcgtcccgctcgctgggagagaggtacctctccttttccctctccctttccctaagctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggcca

SEQ ID NO: 17268 - DNA, 696 bp, Homo sapiens
gtggaacaagccgcctgcagtacagtgcgaggcgggtgatttgcacttgtttagtcaagtcacctcacatcctttttctctttatcaaaatagtattagtccaggttcctccagagaggatcgtgtggtgtgggaccttccggtttccagacaaagggttttggagtaccgtggtgtagtcgccgcatcgttctttgcatttcgagctctgtgccatgttctgtgttcggcatttaccgtggatgaatatcccctagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatattta

SEQ ID NO: 17269 - DNA, 2518 bp, Homo sapiens
gcgtcccgctcgctgggagagaggtacctctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctg

SEQ ID NO: 17270 - DNA, 770 bp, Homo sapiens
agtcaagtcacctcacatcctttttctctttatcaaaatagtattagtccaggttcctccagagaggatcgtgtggtgtgggaccttccggtttccagacaaagggttttggagtaccgtggtgtagtcgccgcatcgttctttgcatttcgagctctgtgccatgttctgtgttcggcatttaccgtggatgaatatcccctaggtgtttatcctgctctgtggccctgttctgtggaatattcctattggatcagttacagttttttagccagatatttctagaacggttatggtggttctgaaatggctagtctttcgggcgcgctggaataatgtgaagaatcgttgatttcgtagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtac

SEQ ID NO: 17271 - DNA, 1530 bp, Homo sapiens
cgccgttgctgcgggggattgtgggagtctccgcgtcccgctcgctgggagagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaa

SEQ ID NO: 17272 - DNA, 2243 bp, Homo sapiens
tttcccctccggcctctgccggtgctgctgcgccctgcggagctccgaacacgtgcgcagaggctggctgtggcagatgcaactgcaggatgacttgaaagtagggcatccttcacccatctgaagggaggaaatagtggcaggtgacagtctgcatgtgcagttttcagatgccttcacctgaatgacatctacctccatcaggaccccagatgtctgacagccctgtgtgacaccaagataagtaacgagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattca

SEQ ID NO: 17273 - DNA, 664 bp, Homo sapiens
ctgcgccctgcggagctccgaacacgtgcgcagaggctggctgtggcagatgcaactgcaggatgacttgaaagtagggcatccttcacccatctgaagggaggaaatagtggcaggtgacagtctgcatgtgcagttttcagatgccttcacctgaatgacatctacctccatcaggaccccagatgtctgacagccctgtgtgacaccaagataagtaacaatctggctgctgactaccctattggacaactccaatattagagaacatttccaccaattcagaaagtttattatgcactgctgttctagagcagggatcagcaaacttgctgtaaagagccagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccag

SEQ ID NO: 17274 - DNA, 561 bp, Homo sapiens
gtatgtgagccgcctgatcggcggccgccatgttaggagcgcagtggcggcgcaaccagccttctagggcggcggaggtgagcggtccgggagggaaacacgcggccggccaagggcccagggtgcggcgggagattttgggtgaagagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtactt

SEQ ID NO: 17275 - DNA, 3249 bp, Homo sapiens
gcagcaacggaaaggcgccacgctcgtgagcggaaccagcgttccgggggcgctcagtgtgggcaggcaggaagcctggctccactaggacacacagattctctcctgagcagctgcgaactatgcgccccttctacccttaagagatgggatgggagtccaacaaacccagccattgctcagaccccagcccttctctcctctaagaagcaggttcacctctgccaccgcactcgcatttttttttttttttaaagcccggcctttcctaggcggggtcaagggccccgcccaccgaagccacgcccagtagccgccccggggcggggttcccctcggctcccggctgccctttcccctccggcctctgccggtgctgctgcgccctgcggagctccgaacacgtgcgcagaggctggctgtggcagatgcaactgcagatgccttcacctgaatgacatctacctccatcaggaccccagatgtctgacagccctgtgtgacaccaagataagtaacagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaa

SEQ ID NO: 17276 - DNA, 455 bp, Homo sapiens
tctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatct

SEQ ID NO: 17277 - DNA, 564 bp, Homo sapiens
atcgcgtaaaaatggccgaaaaatgaaacgttaacgcttgtttttcgtactgcgtcgtggaacaagccgcctgcagtacagtgcgagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaa

SEQ ID NO: 17278 - DNA, 587 bp, Homo sapiens
tttcccctccggcctctgccggtgctgctgcgccctgcggagctccgaacacgtgcgcagaggctggctgtggcagatgcaactgcagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccagg

SEQ ID NO: 17279 - DNA, 1986 bp, Homo sapiens
caggtattctgaaggtgaaagataccagagattctcaaagatgcgagttttctgtgtgggactactccttttcagtgtgacctgggcagcaccaacatttcaaccacagactgagaaaactaagcaaagctgtgtggaagagcagaggcaggaagaaaaaaacaaagacaatattggttttcaccatttgggcaagagaataaatcaagagctatcatctaaagaaaatattgtccaggaaagaaagaaagatttgtccctttctgaagccagtgagaataagggaagtagtaaatctcaaaattatttcacaaatagacagagactgaataaagaatatagtatcagtaacaaagagaatactcacaatggcctgaggatgtcaatttatcctaagtcaactgggaataaagggtttgaggatggagatgatgctatcagcaaactacatgaccaagaagaatatggcgcagctctcatcagaaataacatgcaacatataatggggccagtgactgcgattaaactcctgggggaagaaaacaaagagaacacacctaggaatgttctaaacataatcccagcaagtatgaattatgctaaagcacactcgaaggataaaaagaagcctcaaagagattcccaagcccagaaaagtccagtaaaaagcaaaagcacccatcgtattcaacacaacattgactacctaaaacatctctcaaaagtcaaaaaaatccccagtgattttgaaggcagcggttatacagatcttcaagagagaggggacaatgatatatctcctttcagtggggacggccaaccttttaaggacattcctggtaaaggagaagctactggtcctgacctagaaggcaaagatattcaaacagggtttgcaggcccaagtgaagctgagagtactcatcttgacacaaaaaagccaggttataatgagatcccagagagagaagaaaatggtggaaataccattggaactagggatgaaactgcgaaagaggcagatgctgttgatgtcagccttgtagagggcagcaacgatatcatgggtagtaccaattttaaggagctccctggaagagaaggaaacagagtggatgctggcagccaaaatgctcaccaagggaaggttgagtttcattaccctcctgcaccctcaaaagagaaaagaaaagaaggcagtagtgatgcagctgaaagtaccaactataatgaaattcctaaaaatggcaaaggcagtaccagaaagggtgtagatcattctaataggaaccaagcaaccttaaatgaaaaacaaaggtttcctagtaagggcaaaagtcagggcctgcccattccttctcgtggtcttgataatgaaatcaaaaacgaaatggattcctttaatggccccagtcatgagaatataataacacatggcagaaaatatcattatgtaccccacagacaaaataattctacacggaataagggtatgccacaagggaaaggctcctggggtagacaaccccattccaacaggaggtttagttcccgtagaagggatgacagtagtgagtcatctgacagtggcagttcaagtgagagcgatggtgactagtccaccaggagttcccagcggggtgacagtctgaagacctcgtcacctgtgagttgatgtagaggagagccacctgacagctgaccaggtgaagagaggatagagtgaagaactgagtgagccaagaatcctggtctccttgggggaatttttgctatcttaatagtcacagtataaaattctattaaaggctataatgtttttaagcaaaaaaaaatcattacagatctatgaaataggtaacatttgagtaggtgtcatttaaaaatagttggtgaatgtcacaaatgccttctatgttgtttgctctgtagacatgaaaataaacaatatctctcgatgataatttgtattaagtaatctataag

SEQ ID NO: 17280 - DNA, 2022 bp, Homo sapiens
atgcagtgctcccctggcctgccggcagctatccacaccagaaagaggaaaaggtagactgagattctcaaagatgcgagttttctgtgtgggactactccttttcagtgtgacctgggcagcaccaacatttcaaccacagactgagaaaactaagcaaagctgtgtggaagagcagaggcaggaagaaaaaaacaaagacaatattggttttcaccatttgggcaagagaataaatcaagagctatcatctaaagaaaatattgtccaggaaagaaagaaagatttgtccctttctgaagccagtgagaataagggaagtagtaaatctcaaaattatttcacaaatagacagagactgaataaagaatatagtatcagtaacaaagagaatactcacaatggcctgaggatgtcaatttatcctaagtcaactgggaataaagggtttgaggatggagatgatgctatcagcaaactacatgaccaagaagaatatggcgcagctctcatcagaaataacatgcaacatataatggggccagtgactgcgattaaactcctgggggaagaaaacaaagagaacacacctaggaatgttctaaacataatcccagcaagtatgaattatgctaaagcacactcgaaggataaaaagaagcctcaaagagattcccaagcccagaaaagtccagtaaaaagcaaaagcacccatcgtattcaacacaacattgactacctaaaacatctctcaaaagtcaaaaaaatccccagtgattttgaaggcagcggttatacagatcttcaagagagaggggacaatgatatatctcctttcagtggggacggccaaccttttaaggacattcctggtaaaggagaagctactggtcctgacctagaaggcaaagatattcaaacagggtttgcaggcccaagtgaagctgagagtactcatcttgacacaaaaaagccaggttataatgagatcccagagagagaagaaaatggtggaaataccattggaactagggatgaaactgcgaaagaggcagatgctgttgatgtcagccttgtagagggcagcaacgatatcatgggtagtaccaattttaaggagctccctggaagagaaggaaacagagtggatgctggcagccaaaatgctcaccaagggaaggttgagtttcattaccctcctgcaccctcaaaagagaaaagaaaagaaggcagtagtgatgcagctgaaagtaccaactataatgaaattcctaaaaatggcaaaggcagtaccagaaagggtgtagatcattctaataggaaccaagcaaccttaaatgaaaaacaaaggtttcctagtaagggcaaaagtcagggcctgcccattccttctcgtggtcttgataatgaaatcaaaaacgaaatggattcctttaatggccccagtcatgagaatataataacacatggcagaaaatatcattatgtaccccacagacaaaataattctacacggaataagggtatgccacaagggaaaggctcctggggtagacaaccccattccaacaggaggtttagttcccgtagaagggatgacagtagtgagtcatctgacagtggcagttcaagtgagagcgatggtgactagtccaccaggagttcccagcggggtgacagtctgaagacctcgtcacctgtgagttgatgtagaggagagccacctgacagctgaccaggtgaagagaggatagagtgaagaactgagtgagccaagaatcctggtctccttgggggaatttttgctatcttaatagtcacagtataaaattctattaaaggctataatgtttttaagcaaaaaaaaatcattacagatctatgaaataggtaacatttgagtaggtgtcatttaaaaatagttggtgaatgtcacaaatgccttctatgttgtttgctctgtagacatgaaaataaacaatatctctcgatgataatttgtattaagtaatctataagaaa

SEQ ID NO: 17281 - DNA, 2031 bp, Homo sapiens
tttacataaacaaatgcagtgctcccctggcctgccggcagctatccacaccagaaagaggaaaaggtagactgagattctcaaagatgcgagttttctgtgtgggactactccttttcagtgtgacctgggcagcaccaacatttcaaccacagactgagaaaactaagcaaagctgtgtggaagagcagaggcaggaagaaaaaaacaaagacaatattggttttcaccatttgggcaagagaataaatcaagagctatcatctaaagaaaatattgtccaggaaagaaagaaagatttgtccctttctgaagccagtgagaataagggaagtagtaaatctcaaaattatttcacaaatagacagagactgaataaagaatatagtatcagtaacaaagagaatactcacaatggcctgaggatgtcaatttatcctaagtcaactgggaataaagggtttgaggatggagatgatgctatcagcaaactacatgaccaagaagaatatggcgcagctctcatcagaaataacatgcaacatataatggggccagtgactgcgattaaactcctgggggaagaaaacaaagagaacacacctaggaatgttctaaacataatcccagcaagtatgaattatgctaaagcacactcgaaggataaaaagaagcctcaaagagattcccaagcccagaaaagtccagtaaaaagcaaaagcacccatcgtattcaacacaacattgactacctaaaacatctctcaaaagtcaaaaaaatccccagtgattttgaaggcagcggttatacagatcttcaagagagaggggacaatgatatatctcctttcagtgggacggccaaccttttaaggacattcctggtaaaggagaagctactggtcctgacctagaaggcaaagatattcaaacagggtttgcaggcccaagtgaagctgagagtactcatcttgacacaaaaaagccaggttataatgagatcccagagagagaagaaaatggtggaaataccattggaactagggatgaaactgcgaaagaggcagatgctgttgatgtcagccttgtagagggcagcaacgatatcatgggtagtaccaattttaaggagctccctggaagagaaggaaacagagtggatgctggcagccaaaatgctcaccaagggaaggttgagtttcattaccctcctgcaccctcaaaagagaaaagaaaagaaggcagtagtgatgcagctgaaagtaccaactataatgaaattcctaaaaatggcaaaggcagtaccagaaagggtgtagatcattctaataggaaccaagcaaccttaaatgaaaaacaaaggtttcctagtaagggcaaaagtcagggcctgcccattccttctcgtggtcttgataatgaaatcaaaaacgaaatggattcctttaatggccccagtcatgagaatataataacacatggcagaaaatatcattatgtaccccacagacaaaataattctacacggaataagggtatgccacaagggaaaggctcctggggtagacaaccccattccaacaggaggtttagttcccgtagaagggatgacagtagtgagtcatctgacagtggcagttcaagtgagagcgatggtgactagtccaccaggagttcccagcggggtgacagtctgaagacctcgtcacctgtgagttgatgtagaggagagccacctgacagctgaccaggtgaagagaggatagagtgaagaactgagtgagccaagaatcctggtctccttgggggaatttttgctatcttaatagtcacagtataaaattctattaaaggctataatgtttttaagcaaaaaaaaatcattacagatctatgaaataggtaacatttgagtaggtgtcatttaaaaatagttggtgaatgtcacaaatgccttctatgttgtttgctctgtagacatgaaaataaacaatatctctcgatgataatttgtattaagtaatctataag

SEQ ID NO: 17282 - DNA, 2135 bp, Homo sapiens
aatcctgcaacaagaagccaggtattctgaaggtgaaagataccagagattctcaaagatgcgagttttctgtgtgggactactccttttcagtgtgacctgggcagcaccaacatttcaaccacagactgagaaaactaagcaaagctgtgtggaagagcagagggctcctcaagcctctctactacaaaactctgggtcccagaatcttcctgatccccatcccatgcctcggcccacatctcgctctgcttcaggacctgtggctgcaggtgtgatactcatggacctcagcaggaagaaaaaaacaaagacaatattggttttcaccatttgggcaagagaataaatcaagagctatcatctaaagaaaatattgtccaggaaagaaagaaagatttgtccctttctgaagccagtgagaataagggaagtagtaaatctcaaaattatttcacaaatagacagagactgaataaagaatatagtatcagtaacaaagagaatactcacaatggcctgaggatgtcaatttatcctaagtcaactgggaataaagggtttgaggatggagatgatgctatcagcaaactacatgaccaagaagaatatggcgcagctctcatcagaaataacatgcaacatataatggggccagtgactgcgattaaactcctgggggaagaaaacaaagagaacacacctaggaatgttctaaacataatcccagcaagtatgaattatgctaaagcacactcgaaggataaaaagaagcctcaaagagattcccaagcccagaaaagtccagtaaaaagcaaaagcacccatcgtattcaacacaacattgactacctaaaacatctctcaaaagtcaaaaaaatccccagtgattttgaaggcagcggttatacagatcttcaagagagaggggacaatgatatatctcctttcagtggggacggccaaccttttaaggacattcctggtaaaggagaagctactggtcctgacctagaaggcaaagatattcaaacagggtttgcaggcccaagtgaagctgagagtactcatcttgacacaaaaaagccaggttataatgagatcccagagagagaagaaaatggtggaaataccattggaactagggatgaaactgcgaaagaggcagatgctgttgatgtcagccttgtagagggcagcaacgatatcatgggtagtaccaattttaaggagctccctggaagagaaggaaacagagtggatgctggcagccaaaatgctcaccaagggaaggttgagtttcattaccctcctgcaccctcaaaagagaaaagaaaagaaggcagtagtgatgcagctgaaagtaccaactataatgaaattcctaaaaatggcaaaggcagtaccagaaagggtgtagatcattctaataggaaccaagcaaccttaaatgaaaaacaaaggtttcctagtaagggcaaaagtcagggcctgcccattccttctcgtggtcttgataatgaaatcaaaaacgaaatggattcctttaatggccccagtcatgagaatataataacacatggcagaaaatatcattatgtaccccacagacaaaataattctacacggaataagggtatgccacaagggaaaggctcctggggtagacaaccccattccaacaggaggtttagttcccgtagaagggatgacagtagtgagtcatctgacagtggcagttcaagtgagagcgatggtgactagtccaccaggagttcccagcggggtgacagtctgaagacctcgtcacctgtgagttgatgtagaggagagccacctgacagctgaccaggtgaagagaggatagagtgaagaactgagtgagccaagaatcctggtctccttgggggaatttttgctatcttaatagtcacagtataaaattctattaaaggctataatgtttttaagcaaaaaaaaatcattacagatctatgaaataggtaacatttgagtaggtgtcatttaaaaatagttggtgaatgtcacaaatgccttctatgttgtttgctctgtagacatgaaaataaacaatatctctcgatgataatttgtattaagtaatctataagaaa

SEQ ID NO: 17283 - DNA, 2206 bp, Homo sapiens
aatcctgcaacaagaagccaggtattctgaaggtgaaagataccagagattctcaaagatgcgagttttctgtgtgggactactccttttcagtgtgacctgggcagcaccaacatttcaaccacagactgagaaaactaagcaaagctgtgtggaagagcagaggataacatacaagggtcactatgagaaacatgggcattatgtttttaagtgtgtttacatgtcacctgagaagaaaaatcaaactgatgtaaaggctcctcaagcctctctactacaaaactctgggtcccagaatcttcctgatccccatcccatgcctcggcccacatctcgctctgcttcaggacctgtggctgcagcaggaagaaaaaaacaaagacaatattggttttcaccatttgggcaagagaataaatcaagagctatcatctaaagaaaatattgtccaggaaagaaagaaagatttgtccctttctgaagccagtgagaataagggaagtagtaaatctcaaaattatttcacaaatagacagagactgaataaagaatatagtatcagtaacaaagagaatactcacaatggcctgaggatgtcaatttatcctaagtcaactgggaataaagggtttgaggatggagatgatgctatcagcaaactacatgaccaagaagaatatggcgcagctctcatcagaaataacatgcaacatataatggggccagtgactgcgattaaactcctgggggaagaaaacaaagagaacacacctaggaatgttctaaacataatcccagcaagtatgaattatgctaaagcacactcgaaggataaaaagaagcctcaaagagattcccaagcccagaaaagtccagtaaaaagcaaaagcacccatcgtattcaacacaacattgactacctaaaacatctctcaaaagtcaaaaaaatccccagtgattttgaaggcagcggttatacagatcttcaagagagaggggacaatgatatatctcctttcagtggggacggccaaccttttaaggacattcctggtaaaggagaagctactggtcctgacctagaaggcaaagatattcaaacagggtttgcaggcccaagtgaagctgagagtactcatcttgacacaaaaaagccaggttataatgagatcccagagagagaagaaaatggtggaaataccattggaactagggatgaaactgcgaaagaggcagatgctgttgatgtcagccttgtagagggcagcaacgatatcatgggtagtaccaattttaaggagctccctggaagagaaggaaacagagtggatgctggcagccaaaatgctcaccaagggaaggttgagtttcattaccctcctgcaccctcaaaagagaaaagaaaagaaggcagtagtgatgcagctgaaagtaccaactataatgaaattcctaaaaatggcaaaggcagtaccagaaagggtgtagatcattctaataggaaccaagcaaccttaaatgaaaaacaaaggtttcctagtaagggcaaaagtcagggcctgcccattccttctcgtggtcttgataatgaaatcaaaaacgaaatggattcctttaatggccccagtcatgagaatataataacacatggcagaaaatatcattatgtaccccacagacaaaataattctacacggaataagggtatgccacaagggaaaggctcctggggtagacaaccccattccaacaggaggtttagttcccgtagaagggatgacagtagtgagtcatctgacagtggcagttcaagtgagagcgatggtgactagtccaccaggagttcccagcggggtgacagtctgaagacctcgtcacctgtgagttgatgtagaggagagccacctgacagctgaccaggtgaagagaggatagagtgaagaactgagtgagccaagaatcctggtctccttgggggaatttttgctatcttaatagtcacagtataaaattctattaaaggctataatgtttttaagcaaaaaaaaatcattacagatctatgaaataggtaacatttgagtaggtgtcatttaaaaatagttggtgaatgtcacaaatgccttctatgttgtttgctctgtagacatgaaaataaacaatatctctcgatgataatttgtattaagtaatctataagaaa

SEQ ID NO: 17284 - DNA, 1405 bp, Homo sapiens
tctcccactggttcctcccctctcaactgctctggttcttataaaaacctcacagccttccactaacatcccgtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattacagaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttcttttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccgggccaggcacagtggccacacctgtaatctcagtagccatgaccataccaatgcactccagcctgtgaaacagagtgagactctgtctctacagaaaaataaaaaagaaaagaaagaaaag

SEQ ID NO: 17285 - DNA, 694 bp, Homo sapiens
cccgtaggagcctctctccctactgctgctacacaagaccctgagactgacctgcaggacgaaaccatgaagagcctgatccttcttgccatcctggccgccttagcggtagtaactttgtgttatggagagtggcagaaagaagaaaacttcggctttgatatcgtttcagttctctctctgaactggcatcgtgcccaggaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattacagaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgat

SEQ ID NO: 17286 - DNA, 4996 bp, Homo sapiens
cggcggccgggggcagcgcggctccttcccttgttgtgtgtgtcggtgcctcctcgccatcttgttgcaaagccctttcttgtcggcgggactcccgggggccgcggggcgggaggcatcggaagggaggtagagagggaggggaagaagggaggcagtgccgccttttttttttttttgcatcccatttttttaaatttgcaattttatattttgcaaatattttgagagacattgatttttctccccgtgctcccccgttcttccctgcggagtgcgctgcgccgcccagccctgtcgccccccggaggtgatccctccctcctgcctgcccgccagcctgacctgtgcccggctcgcgggccgcagcctcggccccggcgcgcccccggcagctctcggcgcgatgagcatagagacgctactggaggcggcccgcttcctggaatggcaagcgcagcaacaacagagagcacgtgaggagcaggagcggcttcgcttggagcaggagcgagagcaggaacagaagaaggccaatagcctggccaggctggcacatacccttcctgtggaggaaccccgcatggaggcgccacccctgcctctgtctccaccggctcccccgccggcacccccaccaccacttgccacccctgccccactgactgtcatccctatccctgtggtgaccaactcccctcagcctctacccccacccccacccttgcccgcggcagcccagcctctgcccctggcgcctcgtcagccggccctggttggcgcccccggactcagcattaaggagcctgcccccctgcccagcaggccgcaggtgcccacccctgctcccctactgccggactcgaaggccaccattccacccaatggcagccccaagcctttgcagcccctccccacgcctgtcctgaccatagcgccacaccctggagtccagcctcagctggccccccagcagccgcccccacccacgctggggaccctgaagttggcaccagctgaagaagtcaaatccagtgaacagaagaagaggcccggggggatcggaaccagagaagtccacaacaaattggagaagaacaggagggcccatctgaaagagtgctttgagaccctgaagcggaacatccccaacgtggatgacaagaagacgtccaatctgagcgtgctgcggacggcgctgcggtacatccagtccctgaagaggaaggagaaggaatatgagcatgaaatggagcggctggcacgtgagaagattgccacgcagcagcggctggcagagctcaagcacgagctgagccagtggatggacgtactggagattgaccgcgtgctgcggcagacgggccagcccgaggatgaccaggcctccacctccaccgcctctgagggtgaggacaacatagacgaggatatggaggaggaccgggcgggcctgggcccacctaagctgagccatcgtccccagccggagctgctgaagtccaccctgccaccccccagcaccacccctgcgcctctgcctccacacccacaccctcacccccactccgtggccctacctcctgcccacctccccgtgcagcagcagcagccacagcagaagacccctctgccagcccctcctcccccaccggctgcccctgcccagacactggtgccagctccagcccatctggtggcgacggctgggggtggctccacggtcatcgcccacacagccaccactcacgcttcagtcatccagactgtgaaccacgttctgcaggggccaggcggcaagcacatcgcccacatcgccccctcggcccccagccctgcggtgcaactggcgcctgccacaccccccattgggcacatcactgtgcaccctgccaccctcaaccatgtggcccacctgggctcccagctgcccttgtacccgcagcccgtggcagtgagccacatcgcccacaccctctcgcaccagcaagtcaacggcacggccggcctggggcccccggctactgtcatggcaaagccggccgtgggggctcaggtggtgcaccacccccagctggtgggccagaccgtgctcaaccctgtgaccatggtcaccatgccctccttcccagtcagcacactcaagctggcttgaggacgaggccactcagaggcccccagtggggacagggagggggacctgtcccccactctctcacccaccagctccacacattccagccaggcccaggccagcccccccacccacccccaggcctcctaggggaagggggtgcaaagactctgagccaagggagggaagggccaccctgctgcactaggacttggtaagatgactctgagaaaatgcgagactctgatggaatgtgccacctgtccggcccagtgccagctccagtgccgctcctgcttcccctccctaccctcggaaatcagtgcgatgtggacgtcacgctccctgacttctcccccgccctgccccgccttcgtgtgctgctgctgctattgctgtctggtgaggtggcccaggcccccggctttcctccggagcctcatgttctcttcccaggcctttggaggggaaatggggaaagcagaactgaagccacttggcccagaaagctgcggattggggtgataaggggccttgctctgagcacaggtgacagatcataggaagtggctggtctggagtcccacccggacaggtggggcctcagcctggggctctctgacccggttgcagtcactgtgattcgttaccgtagatactacttaaaatgattctctaccaacaataaaccaaacccagccactgccaagcttcctgtgccctcaccccaatccctgccactgggctctggacctcaggagggcaggctgaggtggggaaggagggacttggctgtccttccccttccccgtcccctgcagcctgggtctggatgggaggagagccactgggcccctgtccccagtccccagtccccagccctgggcttggctcttggcttccagaaggcagcaaagaggggcgctgtcctgcgttcagcccctgatctctgacctctgctgagtgctgggcactgctccaagggacaggtgggcctggcggcctgtgggtttgggtgcctcctgcagtttgggagacatggaccagcatctggtcttgtttccaggagcatagaagccacatcgttgagacatcaggaaggtaaaaacccagcggcttagccaagccctaagcctgtccccagaccaaccctgggacctatacagaacagagggccagagctagggctgctgcttctgctccagcccctttgcctctgtcctcccatcccctcaacaccctgcttctcccggggacgcttttgagtgggccctgcccggggagctgcagagcagcagcacctttctctgagaagaggtccttggttgggtcaaggacagggctgagcgtggaagggggaggagtcaggggctctgtgttaggatgcggctttctctgcctctgggcagcctgctttggcctttccttgtatgtgggtgtttattacaagtggctttgtgtcagacacgctcggctccccacctggacacacactcaccagtggcctttcagtgtagcgggaggaagccggtgtccctggatgtgaagctcacactgatgggctggggcaggggcctgggccggcgagggggccggggggaggggacagagctgaggatttcctggagtgccctgcaggcacagaggaggtcagcaaaggtcttgaatagattttctctggaaataaagaatccttagatgcctaaaaattcccttcctgttccctcctggtcctggacacctcccaggggactgttccttatttctctctcctggtgtgggtaaagggacagttacaaaccaggtcaccatcctcagaggctgagccctgtacccaccccagcacagccacctccgccagaccccgtggctctgggagagccagctttgctattcccattgtgacagcgatggcaggcctgacccacggggcagttagagcagcctcgtggagctcgcccctcccctcagcctgcccacctctccctgcatcctgaggccagtggcccccgggcctgcacagatacctcatcatccacccgctgcccctccccgtccctgtcccccagcatcgggggcctgcaaatctagtgccgaatgactatgtccagattggtgacgatgggtgttgctgtttttcttgtcgtttgtgaacgctgtgatgctgtgtgcccaagtgggcagtcaccacccagcccttccttgggcgtctcccccagagtgctgtcgggaccacatctgtcctcaccctgtgggaccgcctggccctccctccctagcccttccagcctgggacacacacacacacacacacacacacacacgcacgcacacgcacacatcttacctctcatgcgtgttttaccttttgatgttcagagtggctcactggctgggagtccttacctcggggagagggggaggttggttccttggggggccaaagaaggcagggaatgcctggagggtaactggggggccaccatgaccccttctctctccagaaacagctgcttctccccccatcccagggtcccacccccaacccccagaggtggcccttgtttacagtgaggactcggccactgtgtctctgtttcctgaaatataaactgtagcgaccccagactgtagagatttttatgtgtttggatacatctgctgtgtggaaaaaaaaaaaaactacaaaaaccctaattttgtacatactgtatttttactattgaactgtattctagtggctgttcatgctccaagactttagttaccgagacatgaatactatccatgtaataagcacttgcctggaataaaatataaaactgaaataaacctgcactgaaacctgagatggagctgcca

SEQ ID NO: 17287 - DNA, 2438 bp, Homo sapiens
atcttgttgcaaagccctttcttgtcggcgggactcccgggggccgcggggcgggaggcatcggaagggaggtagagagggaggggaagaagggaggcagtgccgccttttttttttttttgcatcccatttttttaaatttgcaattttatattttgcaaatattttgagagacattgatttttctccccgtgctcccccgttcttccctgcggagtgcgctgcgccgcccagccctgtcgccccccggaggtgatccctccctcctgcctgcccgccagcctgacctgtgcccggctcgcgggccgcagcctcggccccggcgcgcccccggcagctctcggcgcgatgagcatagagacgctactggaggcggcccgcttcctggaatggcaagcgcagcaacaacagagagcacgtgaggagcaggagcggcttcgcttggagcaggagcgagagcaggaacagaagaaggccaatagcctggccaggctggcacatacccttcctgtggaggaaccccgcatggaggcgccacccctgcctctgtctccaccggctcccccgccggcacccccaccaccacttgccacccctgccccactgactgtcatccctatccctgtggtgaccaactcccctcagcctctacccccacccccacccttgcccgcggcagcccagcctctgcccctggcgcctcgtcagccggccctggttggcgcccccggactcagcattaaggagcctgcccccctgcccagcaggccgcaggtgcccacccctgctcccctactgccggactcgaaggccaccattccacccaatggcagccccaagcctttgcagcccctccccacgcctgtcctgaccatagcgccacaccctggagtccagcctcagctggccccccagcagccgcccccacccacgctggggaccctgaagttggcaccagctgaagaagtcaaatccagtgaacagaagaagaggcccggggggatcggaaccagagaagtccacaacaaattggagaagaacaggagggcccatctgaaagagtgctttgagaccctgaagcggaacatccccaacgtggatgacaagaagacgtccaatctgagcgtgctgcggacggcgctgcggtacatccagtccctgaagaggaaggagaaggaatatgagcatgaaatggagcggctggcacgtgagaagattgccacgcagcagcggctggcagagctcaagcacgagctgagccagtggatggacgtactggagattgaccgcgtgctgcggcagacgggccagcccgaggatgaccaggcctccacctccaccgcctctgagggtgaggacaacatagacgaggatatggaggaggaccgggcgggcctgggcccacctaagctgagccatcgtccccagccggagctgctgaagtccaccctgccaccccccagcaccacccctgcgcctctgcctccacacccacaccctcacccccactccgtggccctacctcctgcccacctccccgtgcagcagcagcagccacagcagaagacccctctgccagcccctcctcccccaccggctgcccctgcccagacactggtgccagctccagcccatctggtggcgacggctgggggtggctccacggtcatcgcccacacagccaccactcacgcttcagtcatccagactgtgaaccacgttctgcaggggccaggcggcaagcacatcgcccacatcgccccctcggcccccagccctgcggtgcaactggcgcctgccacaccccccattgggcacatcactgtgcaccctgccaccctcaaccatgtggcccacctgggctcccagctgcccttgtacccgcagcccgtggcagtgagccacatcgcccacaccctctcgcaccagcaagtcaacggcacggccggcctggggcccccggctactgtcatggcaaagccggccgtgggggctcaggtggtgcaccacccccagctggtgggccagaccgtgctcaaccctgtgaccatggtcaccatgccctccttcccagtcagcacactcaagctggcttgaggacgaggccactcagaggcccccagtggggacagggagggggacctgtcccccactctctcacccaccagctccacacattccagccagccctgccccgccttcgtgtgctgctgctgctattgctgtctggtgaggtggcccaggcccccggctttcctccggagcctcatgttctcttcccaggcctttggaggggaaatggggaaagcagaactgaagccacttggcccagaaagctgcggattggggtgataaggggccttgctctgagcacaggtgacagatcataggaagtggctggtctggagtcccacccggacaggtggggcctcagcctg

SEQ ID NO: 17288 - DNA, 1033 bp, Homo sapiens
aaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctggagcagctccgggggctggcaggggcggccgagcgggagcggctgcgggcggacagtctggactcctcaggcctctcctctgagcgctcagactcagaccaagaggagctggaggtggatgtggagagcctggtgtttgggggtgaggccgagctgctgcggggcttcgtcgccggccaggagcacagctactcgcacggcggcggcgcctggctatgatgttcctcacccagggcgggcctctgccctctactcgtgccaggcccacttgccaggcaggagccctccccaagccttcagggctgctcggagtcacctgttggaatggactaaaaggacccttgtgtgggaacaggtgctccccaaacaccctgctgctggctgccaggcaggccctctggaagggaaggggcaggactcatcaggacctccctggacccctgcagggcaggcagcttgggcccgagcccaagcatttggctctgctgcccccaaggggacaggaagcctcttgggcctcttcccttcctggacaaggccccctgcctttgcctcacataaactgtacagtattttcattaaaagcctctttc

SEQ ID NO: 17289 - DNA, 1534 bp, Homo sapiens
aaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctggagcagctccgggggctggcaggggcggccgagcgggagcggctgcgggcggacagtctggactcctcaggcctctcctctgagcgctcagactcagaccaaggtgagtgccccgaggctgaggggttgtgtggccctcggggcgagccaggtcttctgaccggacccctccccgcgcagaggagctggaggtggatgtggagagcctggtgtttgggggtgaggccgagctgctgcggggcttcgtcgccggccaggagcacagctactcgcacggcggcggcgcctggctatgatgttcctcacccagggcgggcctctgccctctactcgtgccaggcccacttgccaggcaggagccctccccaagccttcagggctgctcggagtcacctgttggaatggactaaaaggacccttgtgtgggaacaggtgctccccaaacaccctgctgctggctgccaggcaggccctctggaagggaaggggcaggactcatcaggacctccctggacccctgcagggcaggcagcttgggcccgagcccaagcatttggctctgctgcccccaaggggacaggaagcctcttgggcctcttcccttcctggacaaggccccctgcctttgcctcacataaactgtacagtattttcattaaaagcctctttcataacttcccgtccatagtcttgcctaatgaaaacgggggaactcccaaccacagacccactggaagaggaaataatatcagttcccatcactgacactgttggccgtgccaggcagtgcacttaattctcacaacttgaggctgttctgtctccacttcacggatggtagaaatgaggctgagtgacgtgactcgcctgaggtccaaaaacagtgaagccaagattcaaaccagagccttccgactccagagctggggccaactgaattcaacaagtatttattgagtgtctattatgtgctagatactgagacacatcagagaacaaaaccaaaagccctgcccttgtcgggcttacagtctagcacttaccgccagttaacctgcaggctacct

SEQ ID NO: 17290 - DNA, 2269 bp, Homo sapiens
aacaaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctggagcagctccgggggctggcaggggcggccgagcgggagcggctgcgggcggacagtctggactcctcaggcctctcctctgagcgctcagactcagaccaagtcttgcctaatgaaaacgggggaactcccaaccacagacccactggaagaggaaataatatcagttcccatcactgacactgttggccgtgccaggcagtgcacttaattctcacaacttgaggctgttctgtctccacttcacggatggtagaaatgaggctgagtgacgtgactcgcctgaggtccaaaaacagtgaagccaagattcaaaccagagccttccgactccagagctggggccaactgaattcaacaagtatttattgagtgtctattatgtgctagatactgagacacatcagagaacaaaaccaaaagccctgcccttgtcgggcttacagtctagcacttaccgccagttaacctgcaggctacctggagccccgggcaagtcaccgcacctctgtgcctcggtcctcagctgcccaatgggagaataagcagacctggctcagacatgaatcatgtgcttggtgtactgcagatgccaaactgcatccccacaacccaccacgtagacagcagacagggctggaagttgatttttaatgataaagtacaatgaagggagggcagagaggctaagcctagctgtctggggtgctgtggtggtggtagactggctacacaaactgttgctgctgctgctgcttcttggtggccgccttgctggcgaggtccttggccttctctgtagctgccagtgccgtctcctttgccttctccttggcttccttggctgtctcaacaagtgttttggaaggggcctcgcctgtcgcgaacggcaggtggctgcctttagaagatgcctgaaagaccaacctaatttccctcccccatgacaccaatctcctctgggccaggctccactaaaaaggtggtattcaccctcctcccacccccagtacagacaaggagtcccagctcagagcagggcaatgactaacccagactccacgcccgctaggctgaatgagcctctccctatgaggaatatccacatacccagaaactcaccttgcagcttagccaagatatattcaaaacccttcatagtcttggtcacgttgcttttgaatcgggcaagaccaaattcctggcatgagatgagaatgggaaggatactgagttgcccactgaccccagcccagccccaacaccgaaagcactgggtcccagagccccagcagccccaacaacactgctcacctggacagctctggagacaccaaataagctagaggagacccaggcttcccggcggatttcagtccagccactgttgtcagagttcacacagtaaacacatcgttcctccaccacctatgcagaggccaaccacaatcgtggaacagtctttcattttgccaacttgcacataaatctgactccctgtcacttttcatgaggcgaagcaatacaatgaaaatccattccttcccctgactgcacctccaagtggcactgacagaacaagaagccataaataaggtcgttttgctctcgaaaacctctcttctgactcttaaactagaaggcaaaaggtctctctcttgagatcaacaaagggccttccagcccatcctgctcctggattttgttttgtgcatctagacgcatgcagtgttttagccgccttccaccagctgcagctctggagcttcctgacagtccaaataaaaacatttgcccgg

SEQ ID NO: 17291 - DNA, 1483 bp, Homo sapiens
cggccggaggccccgcccccgcggcacccacgtgcagcggctgggcccggcgctttcaggggaccaccaggcccccagagcgccgtgctatgttgggggctagtcactagcacggggctggaagctgagatcaaagacgccaatgagccggcgtgggtggatgagtgaggcgggcaagaagcagcaccggttagcctgagggttcgctccagggccaggcctggagccagcgcccttacctgcccctggaaagtctgagaccactcggggcggggcggctgccggagggtgggctgcggctccgtggcgggttccagaggggcggagccaagggctgggcgttcccgcgggcggggcgtcccgggggcggggcgggcccctgtgtttgttgcaccgtgtcagttactttgtaacaaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctggagcagctccgggggctggcaggggcggccgagcgggagcggctgcgggcggacagtctggactcctcaggcctctcctctgagcgctcagactcagaccaagaggagctggaggtggatgtggagagcctggtgtttgggggtgaggccgagctgctgcggggcttcgtcgccggccaggagcacagctactcgcacggcggcggcgcctggctatgatgttcctcacccagggcgggcctctgccctctactcgtgccaggcccacttgccaggcaggagccctccccaagccttcagggctgctcggagtcacctgttggaatggactaaaaggacccttgtgtgggaacaggtgctccccaaacaccctgctgctggctgccaggcaggccctctggaagggaaggggcaggactcatcaggacctccctggacccctgcagggcaggcagcttgggcccgagcccaagcatttggctctgctgcccccaaggggacaggaagcctcttgggcctcttcccttcctggacaaggccccctgcctttgcctcacataaactgtacagtattttcattaaaagcctctttcataacttcc

SEQ ID NO: 17292 - DNA, 861 bp, Homo sapiens
gaaaaggccatttcgcgtgcctccaggtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctggagcagctccgggggctggcaggggcggccgagcgggagcggctgcgggcggacagtctggactcctcaggcctctcctctgagcgctcagactcagaccaagaggagctggaggtggatgtggagagcctggtgtttgggggtgaggccgagctgctgcggggcttcgtcgccggccaggagcacagctactcgcacggcggcggcgcctggctatgatgttcctcacccagggcgggcctctgccctctactcgtgccaggcccacttgccaggcaggagccctccccaagccttcagggctgctcggagtcacctgttggaatggactaaaaggacccttgtgtgggaacaggtgctccccaaacaccc

SEQ ID NO: 17293 - DNA, 12042 bp, Homo sapiens
gcgcgcgcgcaggctcttcagctggagcggacacacggtgtgcgaaccgaacagaataacccgcccccagcgggatgtgaaggactccgggtgaggccggccacgccccgcacggatgggaaggccattgtgactatgtggtgattacagttgtcttactactgagtttcctactgaaatcatggaggagaaacagcagattatattggctaatcaagatggtggaacagtggcaggagcagcacctaccttctttgtcatcttaaagcagccaggaaatggcaaaactgatcaaggaattttggttactaatcaggatgcctgtgctttggctagtagtgtgtcatcaccagtaaaatctaaagggaagatttgccttccagctgattgtactgtgggtggaatcactgttaccctcgataacaatagtatgtggaatgagttctatcatcgaagcacagagatgattctgaccaagcaaggaagacgcatgtttccttactgtcgttattggataacaggtttagattcaaatttgaagtatattcttgtcatggatatatctcctgtggataaccatcgttataagtggaatggtcgttggtgggaacctagtgggaaggctgaacctcatgttttggggagggttttcattcatccagaatctccttccacaggtcattattggatgcatcaaccagtatctttctataaactcaaacttaccaacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataagccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatgtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaacagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggaagctctagacattcatgcagttgatgggacaacagaagaatcttctagtctccaggcatcaaccacaaatgactcaggttacagagcaagaatttcccagttggaaaaggaattgatagaagatttgaagactttgcggcacaagcaggtgatacatcctggtcttcaagaagtgggcttaaaattgaattcagtggatccaacaatgagcattgatcttaaatacttgggagtacagttacctttggctccagctactagctttcctttttggaaccttacaggaaccaaccctgcctctcctgatgcgggatttccctttgtttctaggacagggaaaaccaatgatttcactaagatcaagggatggaggggaaaatttcatagtgcttctgcatctaggaatgaaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactctacttacagctcaagcatccctcaaaactaaacctatccacacaatcataaggaaacgagcccctccctgcaacaatgacttctgtcgactgggttgtgtatgttccagtctagctttggagaagcgccaacctgctcactgccgccgaccagactgcatgtttggttgtacttgtttgaaaagaaaagttgtacttgttaaaggaggatccaaaactaagcattttcagaggaaggctgctcatcgagatccagtattttatgatactctgggagaggaggcaagggaggaggaagaaggaatcagggaggaggaggaacaattgaaagagaaaaagaagagaaagaagctagaatacactatatgtgagacagagcctgaacagcctgttcgacattacccattatgggtaaaagtagaaggtgaagtagatccagaaccagtttatatccccacgccttctgtcattgagcctatgaaaccattgttattgcctcagccagaagttttatctcctactgtgaagggcaaactgctcactggaattaaatctccacggtcatatactcccaaacccaatcctgtgattcgggaagaggacaaagatccagtctacttgtactttgaaagtatgatgacttgtgctcgagttcgagtatatgagcgaaaaaaagaggaccagagacaaccatcttcctcctcctccccatctccatcatttcagcagcaaacttcatgtcattctagccctgagaaccataataatgcaaaggaacctgattctgaacagcagcccttaaaacaactcacctgtgacttggaggatgattctgataaattacaagaaaagagctggaagtcttcctgcaatgaaggagaatcctcttctacttcttatatgcatcagaggtcacctggtggtcccaccaaactgattgagatcatctcagactgcaactgggaggaagatcggaacaagattttgagcatcttatcccagcacatcaatagcaacatgccacaatcacttaaggtgggcagcttcatcattgagttggcttctcagcgaaagagccggggtgagaagaaccctcctgtttattcttctcgtgtgaaaatctctatgccatcatgtcaagaccaagatgatatggctgagaaatctggatcagagactcctgatggtccattgtcccctgggaaaatggaggatatctctcctgtgcagacagatgccctggattcagtgagggagagattacatggaggcaaaggtctgcctttttatgcagggctttctcctgcagggaagcttgtggcctataaacgtaaacccagttcaagtacatctgggcttatccaggtagcatccaatgccaaggtggctgcatccaggaaaccacgtaccctgttgccttcaacatccaattccaaaatggcatcctcctctggcactgcaacaaatcgccctgggaagaatctgaaggcgtttgtcccagcaaaacggccaattgcggctcgaccctctcctggtggtgtgttcacacagtttgtgatgagtaaagttggagccttgcagcagaagatacctggagttagcacaccccaaaccctggcagggacacagaagttcagtatcagaccttctccagtaatggtcgtcacacctgtggtttcttctgagccagttcaggtgtgcagccctgtgactgctgctgtcactactaccacccctcaagtgtttttagaaaatactactgctgtgacacctatgactgctatttctgacgtggaaactaaagaaactacttattcttctggtgccaccactacaggggttgttgaggtctctgaaactaataccagcacctctgtaacatctacccagtctacagccactgtgaaccttaccaaaaccactgggataactacccctgtggcttcagttgcttttcctaagtctttggtagcatctccttcaaccataactcttcctgttgcttccactgcttccacctccttagtcgtggtgactgcagctgcatcttcctccatggtgaccacaccaacttcatctctgggctctgttcctattatactctcaggaattaatgggagtccaccagtgagccagagaccagaaaatgctgctcaaattccagtggctactccacaggtctctcctaacacagtgaaacgtgctggacctcgattgttgttgattccagtgcagcagggttctcctactcttagacctgtctcaaacacacaacttcagggacatcggatggtcttgcagcctgttaggagtccaagtggaatgaacttattcaggcaccctaatgggcagattgtccagcttctacctttgcatcagcttcgaggctctaatacccagcccaacttacagcctgtcatgtttcggaacccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaagagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaagaataactgtgtagaatacattgaggatgatgaggagcacgtggacattgagactgtagaagagctctcagaggaaattaatgttgctcacctgaagaccacagcggcccacacacagtcattcaaacagccgtcctgtactcacatctctgcagatgaaaaagcagctgaaaggagtcgaaaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcacaaaaaagaaaaaagaagatgggatcagatgagtttgacatatctcccagaattagcaaacagcaggaaggatcttctgcatcatctgtagatcttggacagatgtttataaataacaggagggggaaacctttgattctttccagaaaaaaagaccaggccacagaaaatacctcacccttgaacactccacacacctctgccaaccttgtgatgactccgcaagggcaattgctcaccctaaaaggtcccctattctcaggaccagtggtagctgtttctcctgatctcttagaatctgatcttaagcctcaagttgccggtagtgctgtggctctaccagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaatagatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttacctcacttgtggtgctgggtcccctcatcctctctaagaagatgtgatccattactgaacatgaggtgcccctcttacccaaggaatttataacatgactctggctccacagtggtttctagttcttcccccacaagcgaaagagctgtttgcaactttggagttgctgtagactgaactgtagcttgtagctgttgaattaagtccaaaatctaaggaatgcgatggacttgtgcaaagggatccagaagagacactttttagttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttccttttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaattaaagcagaa

SEQ ID NO: 17294 - DNA, 11921 bp, Homo sapiens
gcgcgcgcgcaggctcttcagctggagcggacacacggtgtgcgaaccgaacagaataacccgcccccagcgggatgtgaaggactccgggtgaggccggccacgccccgcacggatgggaaggccattgtgactatgtggtgattacagttgtcttactactgagtttcctactgaaatcatggaggagaaacagcagattatattggctaatcaagatggtggaacagtggcaggagcagcacctaccttctttgtcatcttaaagcagccaggaaatggcaaaactgatcaaggaattttggttactaatcaggatgcctgtgctttggctagtagtgtgtcatcaccagtaaaatctaaagggaagatttgccttccagctgattgtactgtgggtggaatcactgttaccctcgataacaatagtatgtggaatgagttctatcatcgaagcacagagatgattctgaccaagcaaggaagacgcatgtttccttactgtcgttattggataacaggtttagattcaaatttgaagtatattcttgtcatggatatatctcctgtggataaccatcgttataagtggaatggtcgttggtgggaacctagtgggaaggctgaacctcatgttttggggagggttttcattcatccagaatctccttccacaggtcattattggatgcatcaaccagtatctttctataaactcaaacttaccaacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataagccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatgtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaacagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggaagctctagacattcatgcagttgatgggacaacagaagaatcttctagtctccaggcatcaaccacaaatgactcaggttacagagcaagaatttcccagttggaaaaggaattgatagaagatttgaagactttgcggcacaagcaggtgatacatcctggtcttcaagaagtgggcttaaaattgaattcagtggatccaacaatgagcattgatcttaaatacttgggagtacagttacctttggctccagctactagctttcctttttggaaccttacaggaaccaaccctgcctctcctgatgcgggatttccctttgtttctaggacagggaaaaccaatgatttcactaagatcaagggatggaggggaaaatttcatagtgcttctgcatctaggaatgaaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactctacttacagctcaagcatccctcaaaactaaacctatccacacaatcataaggaaacgagcccctccctgcaacaatgacttctgtcgactgggttgtgtatgttccagtctagctttggagaagcgccaacctgctcactgccgccgaccagactgcatgtttggttgtacttgtttgaaaagaaaagttgtacttgttaaaggaggatccaaaactaagcattttcagaggaaggctgctcatcgagatccagtattttatgatactctgggagaggaggcaagggaggaggaagaaggaatcagggaggaggaggaacaattgaaagagaaaaagaagagaaagaagctagaatacactatatgtgagacagagcctgaacagcctgttcgacattacccattatgggtaaaagtagaaggtgaagtagatccagaaccagtttatatccccacgccttctgtcattgagcctatgaaaccattgttattgcctcagccagaagttttatctcctactgtgaagggcaaactgctcactggaattaaatctccacggtcatatactcccaaacccaatcctgtgattcgggaagaggacaaagatccagtctacttgtactttgaaagtatgatgacttgtgctcgagttcgagtatatgagcgaaaaaaagaggaccagagacaaccatcttcctcctcctccccatctccatcatttcagcagcaaacttcatgtcattctagccctgagaaccataataatgcaaaggaacctgattctgaacagcagcccttaaaacaactcacctgtgacttggaggatgattctgataaattacaagaaaagagctggaagtcttcctgcaatgaaggagaatcctcttctacttcttatatgcatcagaggtcacctggtggtcccaccaaactgattgagatcatctcagactgcaactgggaggaagatcggaacaagattttgagcatcttatcccagcacatcaatagcaacatgccacaatcacttaaggtgggcagcttcatcattgagttggcttctcagcgaaagagccggggtgagaagaaccctcctgtttattcttctcgtgtgaaaatctctatgccatcatgtcaagaccaagatgatatggctgagaaatctggatcagagactcctgatggtccattgtcccctgggaaaatggaggatatctctcctgtgcagacagatgccctggattcagtgagggagagattacatggaggcaaaggtctgcctttttatgcagggctttctcctgcagggaagcttgtggcctataaacgtaaacccagttcaagtacatctgggcttatccaggtagcatccaatgccaaggtggctgcatccaggaaaccacgtaccctgttgccttcaacatccaattccaaaatggcatcctcctctggcactgcaacaaatcgccctgggaagaatctgaaggcgtttgtcccagcaaaacggccaattgcggctcgaccctctcctggtggtgtgttcacacagtttgtgatgagtaaagttggagccttgcagcagaagatacctggagttagcacaccccaaaccctggcagggacacagaagttcagtatcagaccttctccagtaatggtcgtcacacctgtggtttcttctgagccagttcaggtgtgcagccctgtgactgctgctgtcactactaccacccctcaagtgtttttagaaaatactactgctgtgacacctatgactgctatttctgacgtggaaactaaagaaactacttattcttctggtgccaccactacaggggttgttgaggtctctgaaactaataccagcacctctgtaacatctacccagtctacagccactgtgaaccttaccaaaaccactgggataactacccctgtggcttcagttgcttttcctaagtctttggtagcatctccttcaaccataactcttcctgttgcttccactgcttccacctccttagtcgtggtgactgcagctgcatcttcctccatggtgaccacaccaacttcatctctgggctctgttcctattatactctcaggaattaatgggagtccaccagtgagccagagaccagaaaatgctgctcaaattccagtggctactccacaggtctctcctaacacagtgaaacgtgctggacctcgattgttgcaccctaatgggcagattgtccagcttctacctttgcatcagcttcgaggctctaatacccagcccaacttacagcctgtcatgtttcggaacccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaagagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaagaataactgtgtagaatacattgaggatgatgaggagcacgtggacattgagactgtagaagagctctcagaggaaattaatgttgctcacctgaagaccacagcggcccacacacagtcattcaaacagccgtcctgtactcacatctctgcagatgaaaaagcagctgaaaggagtcgaaaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcacaaaaaagaaaaaagaagatgggatcagatgagtttgacatatctcccagaattagcaaacagcaggaaggatcttctgcatcatctgtagatcttggacagatgtttataaataacaggagggggaaacctttgattctttccagaaaaaaagaccaggccacagaaaatacctcacccttgaacactccacacacctctgccaaccttgtgatgactccgcaagggcaattgctcaccctaaaaggtcccctattctcaggaccagtggtagctgtttctcctgatctcttagaatctgatcttaagcctcaagttgccggtagtgctgtggctctaccagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaatagatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttacctcacttgtggtgctgggtcccctcatcctctctaagaagatgtgatccattactgaacatgaggtgcccctcttacccaaggaatttataacatgactctggctccacagtggtttctagttcttcccccacaagcgaaagagctgtttgcaactttggagttgctgtagactgaactgtagcttgtagctgttgaattaagtccaaaatctaaggaatgcgatggacttgtgcaaagggatccagaagagacactttttagttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttccttttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaattaaagc

SEQ ID NO: 17295 - DNA, 11411 bp, Homo sapiens
gcgcgcgcgcaggctcttcagctggagcggacacacggtgtgcgaaccgaacagaataacccgcccccagcgggatgtgaaggactccgggtgaggccggccacgccccgcacggatgggaaggccattgtgactatgtggtgattacagttgtcttactactgagtttcctactgaaatcatggaggagaaacagcagattatattggctaatcaagatggtggaacagtggcaggagcagcacctaccttctttgtcatcttaaagcagccaggaaatggcaaaactgatcaaggaattttggttactaatcaggatgcctgtgctttggctagtagtgtgtcatcaccagtaaaatctaaagggaagatttgccttccagctgattgtactgtgggtggaatcactgttaccctcgataacaatagtatgtggaatgagttctatcatcgaagcacagagatgattctgaccaagcaaggaagacgcatgtttccttactgtcgttattggataacaggtttagattcaaatttgaagtatattcttgtcatggatatatctcctgtggataaccatcgttataagtggaatggtcgttggtgggaacctagtgggaaggctgaacctcatgttttggggagggttttcattcatccagaatctccttccacaggtcattattggatgcatcaaccagtatctttctataaactcaaacttaccaacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataagccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatgtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaacagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggaagctctagacattcatgcagttgatgggacaacagaagaatcttctagtctccaggcatcaaccacaaatgactcaggttacagagcaagaatttcccagttggaaaaggaattgatagaagatttgaagactttgcggcacaagcaggtgatacatcctggtcttcaagaagtgggcttaaaattgaattcagtggatccaacaatgagcattgatcttaaatacttgggagtacagttacctttggctccagctactagctttcctttttggaaccttacaggaaccaaccctgcctctcctgatgcgggatttccctttgtttctaggacagggaaaaccaatgatttcactaagatcaagggatggaggggaaaatttcatagtgcttctgcatctaggaatgaaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactctacttacagctcaagcatccctcaaaactaaacctatccacacaatcataaggaaacgagcccctccctgcaacaatgacttctgtcgactgggttgtgtatgttccagtctagctttggagaagcgccaacctgctcactgccgccgaccagactgcatgtttggttgtacttgtttgaaaagaaaagttgtacttgttaaaggaggatccaaaactaagcattttcagaggaaggctgctcatcgagatccagtattttatgatactctgggagaggaggcaagggaggaggaagaaggaatcagggaggaggaggaacaattgaaagagaaaaagaagagaaagaagctagaatacactatatgtgagacagagcctgaacagcctgttcgacattacccattatgggtaaaagtagaaggtgaagtagatccagaaccagtttatatccccacgccttctgtcattgagcctatgaaaccattgttattgcctcagccagaagttttatctcctactgtgaagggcaaactgctcactggaattaaatctccacggtcatatactcccaaacccaatcctgtgattcgggaagaggacaaagatccagtctacttgtactttgaaagtatgatgacttgtgctcgagttcgagtatatgagcgaaaaaaagaggaccagagacaaccatcttcctcctcctccccatctccatcatttcagcagcaaacttcatgtcattctagccctgagaaccataataatgcaaaggaacctgattctgaacagcagcccttaaaacaactcacctgtgacttggaggatgattctgataaattacaagaaaagagctggaagtcttcctgcaatgaaggagaatcctcttctacttcttatatgcatcagaggtcacctggtggtcccaccaaactgattgagatcatctcagactgcaactgggaggaagatcggaacaagattttgagcatcttatcccagcacatcaatagcaacatgccacaatcacttaaggtgggcagcttcatcattgagttggcttctcagcgaaagagccggggtgagaagaaccctcctgtttattcttctcgtgtgaaaatctctatgccatcatgtcaagaccaagatgatatggctgagaaatctggatcagagactcctgatggtccattgtcccctgggaaaatggaggatatctctcctgtgcagacagatgccctggattcagtgagggagagattacatggaggcaaaggtctgcctttttatgcagggctttctcctgcagggaagcttgtggcctataaacgtaaacccagttcaagtacatctgggcttatccaggtagcatccaatgccaaggtggctgcatccaggaaaccacgtaccctgttgccttcaacatccaattccaaaatggcatcctcctctggcactgcaacaaatcgccctgggaagaatctgaaggcgtttgtcccagcaaaacggccaattgaaaatgctgctcaaattccagtggctactccacaggtctctcctaacacagtgaaacgtgctggacctcgattgttgttgattccagtgcagcagggttctcctactcttagacctgtctcaaacacacaacttcagggacatcggatggtcttgcagcctgttaggagtccaagtggaatgaacttattcaggcaccctaatgggcagattgtccagcttctacctttgcatcagcttcgaggctctaatacccagcccaacttacagcctgtcatgtttcggaacccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaagagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaagaataactgtgtagaatacattgaggatgatgaggagcacgtggacattgagactgtagaagagctctcagaggaaattaatgttgctcacctgaagaccacagcggcccacacacagtcattcaaacagccgtcctgtactcacatctctgcagatgaaaaagcagctgaaaggagtcgaaaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcacaaaaaagaaaaaagaagatgggatcagatgagtttgacatatctcccagaattagcaaacagcaggaaggatcttctgcatcatctgtagatcttggacagatgtttataaataacaggagggggaaacctttgattctttccagaaaaaaagaccaggccacagaaaatacctcacccttgaacactccacacacctctgccaaccttgtgatgactccgcaagggcaattgctcaccctaaaaggtcccctattctcaggaccagtggtagctgtttctcctgatctcttagaatctgatcttaagcctcaagttgccggtagtgctgtggctctaccagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaatagatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttacctcacttgtggtgctgggtcccctcatcctctctaagaagatgtgatccattactgaacatgaggtgcccctcttacccaaggaatttataacatgactctggctccacagtggtttctagttcttcccccacaagcgaaagagctgtttgcaactttggagttgctgtagactgaactgtagcttgtagctgttgaattaagtccaaaatctaaggaatgcgatggacttgtgcaaagggatccagaagagacactttttagttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttccttttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaattaaagc

SEQ ID NO: 17296 - DNA, 2424 bp, Homo sapiens
ggtaaacaaaccacgcgcgggctgcccgcggcacggcgggcgcggctggcgcggctggggcggcaggggcggcggagagcgcgccgagccgcggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaa

SEQ ID NO: 17297 - DNA, 3470 bp, Homo sapiens
atacacacagactcacagcgagaccgacacacactcccatacactcacacacacaactgcaggcagcgaggctcgggaagtcaggccggcttttcgccccggcgccttctctgctccagccggccgggtctccctgggggcccggagctcggccgggccgcgcagccccgttagaggacgagctcggcggacccccgctcctccatgggcaaacgcgggcggccgcgcaaggaggcgcgctgcgagggcgcggggctggcccccgccgcgcccccggctgtgccccccgccgtggccgcgccccagcccccggccctgcccgaggaccccgctggggccaagcccaggtgccccttctcagacattttcaacaccagcgagaactcgatggagaagcacatcaacacttttctgcagaacgtgcagattctgctcgaggccgccagctacctggagcagatcgagaaagaaaacaaaaagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaa

SEQ ID NO: 17298 - DNA, 2188 bp, Homo sapiens
catcgcccgaggcgtccgccctgcaaatctgccagcccccgagaggggtttggaaccttagcacccaagtctaagtcaacttcatagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaa

SEQ ID NO: 17299 - DNA, 879 bp, Homo sapiens
ccctttagcggtggcagcccaaggggctgtagagatggcgcagaaagaccaggaactcggagactgtggtgtcgagagagaaaatgtctttctaagacttgttcgaagtacacaaaaatattgggcttaaagagactctttagaacagagagagttgaaagtaaaggggaatttttgaggcaagcgaagtcaatgaggtgaatgagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaa

SEQ ID NO: 17300 - DNA, 893 bp, Homo sapiens
gcgcgcgtgcgtggggagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaactt

SEQ ID NO: 17301 - DNA, 774 bp, Homo sapiens
gtgtgtgtgagggcagggagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtc

SEQ ID NO: 17302 - DNA, 1156 bp, Homo sapiens
aaaccacgcgcgggctgcccgcggcacggcgggcgcggctggcgcggctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaaccctt

SEQ ID NO: 17303 - DNA, 889 bp, Homo sapiens
cggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaa

SEQ ID NO: 17304 - DNA, 634 bp, Homo sapiens
gggtgctgggagataagaggaaggaggaacacggatgctggggggggtcaggggaagggacgaggccgggagaacactgagcgggggaaaaccggtggagaggggcctttgaatacctgcggggtgatgagatggggtccctttagcggtggcagcccaaggggctgtagagatggcgcagaaagaccaggaactcggagactgtggtgtcgagagagaaaatgtctttctaagacttgttcgaaagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaa

SEQ ID NO: 17305 - DNA, 803 bp, Homo sapiens
gtcaggccggcttttcgccccggcgccttctctgctccagccggccgggtctccctgggggcccggagctcggccgggccgcgcagccccgttagaggacgagctcggcggacccccgctcctccatgggcaaacgcgggcggccgcgcaaggaggcgcgctgcgagggcgcggggctggcccccgccgcgcccccggctgtgccccccgccgtggccgcgccccagcccccggccctgcccgaggaccccgctggggccaagcccaggtgccccttctcagacattttcaacaccagcgagaactcgatggagaagcacatcaacacttttctgcagaacgtgcagattctgctcgaggccgccagctacctggagcagatcgagaaagaaaacaaaaagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgt

SEQ ID NO: 17306 - DNA, 2561 bp, Homo sapiens
cgccacccgcttcctcgccgcagggggcccgcccgctggcccgtttccggtccggtgggtacaagatgacggagccgggcgcctctcccgaggacccttgggtcaaggcaagccccgtgggcgcgcacgccggcgaggggagggcgggtcgggctcgtgcacgtaggggggccggaagacgaggggcttccctcctgtccccaaagtcccccacgctctccgtgccccggggctgcagagaagacagctctcaccccgcgtgtgccaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggc

SEQ ID NO: 17307 - DNA, 2309 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggc

SEQ ID NO: 17308 - DNA, 2399 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggc

SEQ ID NO: 17309 - DNA, 2826 bp, Homo sapiens
atggcagaagcaaatccccggagaggcaagatgaggttcagaaggaatgcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagtgggagttggatactctttctttcaagcatgtaaacttttttcaaaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattga

SEQ ID NO: 17310 - DNA, 2583 bp, Homo sapiens
atggcagaagcaaatccccggagaggcaagatgaggttcagaaggaatgcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaagacctgtgtcggagatggctctcctatattgatgaagctactatgtcaaatggcaagtag

SEQ ID NO: 17311 - DNA, 3688 bp, Homo sapiens
gatctgtcagctgactaatcagggatagtggtttttttttttttttcctccccagcattgctgccactgtgctaatggaagcagccacggcagctttgtttgatagagatttttggctgccgtttttaaatactacccaagaagcagctcgtatttcatcaacgttgcgttgacaattggaaaagaaaagtgtaattgcgtacaggcgaaatggcagaagcaaatccccggagaggcaagatgaggttcagaaggaatgcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggtt

SEQ ID NO: 17312 - DNA, 3913 bp, Homo sapiens
atgccccaagctgccgcttcggcgccgtggacctcagtgtcctgcggcaggatcccaggcctgccccagaacccagatggctgcactttcatgccgatagcccaggcgatccctctgcaggtggacatggccatggccctgcagcgcgtgaggattgccgagaagtacgggaagaactacctctgcctcctgcaagcagtcttcgtggcagaaaccgatctgctcctccgtataaaggacatcagtcatttcttaatgcaagacatcgccttcttgtctggtggccggggaaaggacaatgcttggatcattacgtttccagaaaactgtaattttagatgtataccagaggaagtaatagcaaaagtacttacttacctgacatctattgcaaggcaaaatggatcagactcccggtttaccattattctggatcgaagattggatacatggtcttctctcaaaatctctctccaaaaaatctcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggtt

SEQ ID NO: 17313 - DNA, 3813 bp, Homo sapiens
catgttaagagcaagaaggcttttgttcttggagcaggcagagagtattgtacattcttttggccgaggaaacagaatgagctgcgacagtcttaaggacaaacatttgtgaaaccgatctgctcctccgtataaaggacatcagtcatttcttaatgcaagacatcgccttcttgtctggtggccggggaaaggacaatgcttggatcattacgtttccagaaaactgtaattttagatgtataccagaggaagtaatagcaaaagtacttacttacctgacatctattgcaaggcaaaatggatcagactcccggtttaccattattctggatcgaagattggatacatggtcttctctcaaaatctctctccaaaaaatctcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggtt

SEQ ID NO: 17314 - DNA, 1988 bp, Homo sapiens
ccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggtt

SEQ ID NO: 17315 - DNA, 1916 bp, Homo sapiens
gttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttat

SEQ ID NO: 17316 - DNA, 3346 bp, Homo sapiens
aaactttttttcatgttaagagcaagaaggcttttgttcttggagcaggcagagagtattgtacattcttttggccgaggaaacagaatgagctgcgacagtcttaaggacaaacatttgtgaaaccgatctgctcctccgtataaaggacatcagtcatttcttaatgcaagacatcgccttcttgtctggtggccggggaaaggacaatgcttggatcattacgtttccagaaaactgtaattttagatgtataccagaggaagtaatagcaaaagtacttacttacctgacatctattgcaaggcaaaatggatcagactcccggtttaccattattctggatcgaagattggatacatggtcttctctcaaaatctctctccaaaaaatctcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagtgggagttggatactctttctttcaagcatgtaaacttttttcaaaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagctttt

SEQ ID NO: 17317 - DNA, 3945 bp, Homo sapiens
cctgggttcgccaaggcgggcggccaggcacatgccccaagctgccgcttcggcgccgtggacctcagtgtcctgcggcaggatcccaggcctgccccagaacccagatggctgcactttcatgccgatagcccaggcgatccctctgcaggtggacatggccatggccctgcagcgcgtgaggattgccgagaagtacgggaagaactacctctgcctcctgcaagcagtcttcgtggcagaaaccgatctgctcctccgtataaaggacatcagtcatttcttaatgcaagacatcgccttcttgtctggtggccggggaaaggacaatgcttggatcattacgtttccagaaaactgtaattttagatgtataccagaggaagtaatagcaaaagtacttacttacctgacatctattgcaaggcaaaatggatcagactcccggtttaccattattctggatcgaagattggatacatggtcttctctcaaaatctctctccaaaaaatctcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggtta

SEQ ID NO: 17318 - DNA, 3461 bp, Homo sapiens
aggacatgcctgatcttcttgagcagtccagcacaagctaatccacaaggttcaatcaggctaagtaattggaggaatgtgttaactctgaattacaaggagcagaagggaaggatctgtcagctgactaatcagggatagtggtttttttttttttttcctccccagcattgctgccactgtgctaatggaagcagccacggcagctttgtttgatagagatttttggctgccgtttttaaatactacccaagaagcagctcgtatttcatcaacgttgcgttgacaattggaaaagaaaagtgtaattgcgtacaggcgaaatggcagaagcaaatccccggagaggcaagatgaggttcagaaggaatgcggcttccttccctgggaacttgcacttggttttggttttacgtcctaccagctttcttcaacgaacgttcacagacattggattttggtttagtcaggaggattttatgcttaaattaccagctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggtt

SEQ ID NO: 17319 - DNA, 3413 bp, Homo sapiens
ggctgccctgcagaggccaggtctgcccagcaaacccaggaaggtgtggcgtccccgcttcgcggccaagatggtgctggtgctgcgccatcctttgtgtgcccgggaagggcgttccgggagccgggtcgggggctcctgactcgcactgggcagcatgacggtgcgccggctgtcactgctgtgccgggacctctgggcgctgtggctgctgctgaaggccggcgcagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaagagccctaggaccccacagaagagcccctccctctccattgctctgcacccctgcatcagcaaggccagccccagaaggagcctcggccgagcgtgcaacccggagccgccttgggccctccctgcgacagccggacccgcctccgcatcgggttgcgatgccctctgcatagtttctttctcttccttcatagatgacacggtcactagctctgcctcagaaagctctgcgctttccagaaagcgctttaccctgcagggttttgctaacctcaaaggtcagaaaggtaaaagtagtgcctgccccaaa

SEQ ID NO: 17320 - DNA, 5406 bp, Homo sapiens
ggctgggtttctctagcacctcggcattgtctgcctgctcttccaggcgtgcagggcagtggtggctcgggccaggctctgggaggccgggcactctgaggaggtggctcagccctcttgggttctttcttgtgagttggcgaagcccagagtcaccagggtcctgagcacctgtctcttgtgaccatgcggcacccgcccggcttttagctgtcgcagcagagacccgaaggctgtggctctagcatcagggggtcgcctgtggtccctgcgtgaagaaccagagctgcctccgctttgtagcagcctttgtgacagggcggttcgatggccgagaagggagcatcccggggaaccctgcggcggctgtggtcactgcccaggaggcgccggggaactgcagggcgctcgaggccagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgc

SEQ ID NO: 17321 - DNA, 5260 bp, Homo sapiens
acagtgtggcttggtgccaaccatggcgagggtggagagccccgtgcctgcagcgcgcgcttccctcactgggtcctgcgtccttgggcaggcgatgcccctgcggggaggggctggtccatccccggccagccacggacccacgcatggacccagcgacccacggacctgcttacctgggcgcggcgcgggtggcatgcggccacacggaaggggcgcgctgggctgctgcggcctctgcagcttctacacctgccacggggcggccggagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgc

SEQ ID NO: 17322 - DNA, 3648 bp, Homo sapiens
acctgcggggcgcggagctcggcggacgcgggagggcagcaccacgggcggcagcctcatgtttgactgttggagatttatcctgtgcaagagacctggaagcaacagttattcttccccacaacggcccaatgaggccaaaaaggaggaaacggatcaccaaattgatgtgtctgacgtcatcaggcttgttcaagacacaccggaggcgacggccatggccacagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcaggtaaggcccacgtgccccgagcccacccgtgacgctgccaagggcccgggcgaggaagctgccccgtgtgtgcccggcagagccgacgccgaagcccgtccccgcctgatctccccgcagagtcgagcccggggtcggccgtgctgagcaactcgtccagctgcagcgagggcggccaggcccccttctccgacctgcaggggtagcg

SEQ ID NO: 17323 - DNA, 3903 bp, Homo sapiens
gtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaagcttctcctaccagtcctgacaaaaaagccaagcggcatgaagtaaagagcgacccgactccctttggtgtgcgaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcaggtaaggcccacgtgccccgagcccacccgtgacgctgccaagggcccgggcgaggaagctgccccgtgtgtgcccggcagagccgacgccgaagcccgtccccgcctgatctccccgcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccc

SEQ ID NO: 17324 - DNA, 6580 bp, Homo sapiens
cgcttccctcactgggtcctgcgtccttgggcaggcgatgcccctgcggggaggggctggtccatccccggccagccacggacccacgcatggacccagcgacccacggacctgcttacctgggcgcggcgcgggtggcatgcggccacacggaaggggcgcgctgggctgctgcggcctctgcagcttctacacctgccacggggcggccggagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtaagaccccgcgctcagccccggactgccccgcacgtggctgccgctgaccctcgccccttgcaggtacgtcagggacccgaccactggcaaggagggctgggtgccggccagcagcctgtccgtccggctcggcccgtccggctcggcccagtgcctgagcagctcaggtaaggcccacgtgccccgagcccacccgtgacgctgccaagggcccgggcgaggaagctgccccgtgtgtgcccggcagagccgacgccgaagcccgtccccgcctgatctccccgcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgccatctgcctttgtctgtcaagacacagaacgtctcagcagtcggggtttccagggccgcagtgcactgtgcttgcacatggtaagtcattgttgggacggaaaagaagccggcagtgggcagggcccagcgtgcggctcaggcaccgagcaaccgctttgctttcttctgtcagacggcgatgatgacaaaatagcaacaaggttgtgcgtgtcagaaacgcaaaggcagcagaggaagcgtagtggaaccattacagaatcacaatgcagccgacactctccagaccagaaaagggagcataaagaaagggtattgatccaatagaagaagggaagggtggagaaaggggaaagcatggttaacaggaaacaacatgtaacggaagagacagcccagatgtgtctggctcacaacagacgtgatcatgttatgctggcctggaagagcatcggatcagacgtgacaagtcactgcttagagaccatcaagcaaatttatatatagattggagatttaaaataaaagaagacagaacagacaaacaccataagaaagctggtgtagcagtatcgatgacctgaaatgggattcaggacagttcatagagtaaagggggctgcgtggcaatcaggaactcataagccactgactataaagctcaaaacacagcaaagttggcagtcggcagacagcaatgttgactgtcatgaaaagtgatccctgtttgcccctaaacgtagagaaatctgcgttattttccagcacacatggagcacaaacaaaatatttgcaaaacaatgggaagatcattgaaacactgtttggcaatttaaaagcttgtttctaactcacgggatgcgggcagtctgctctctagaactggacagcgtgcacagagccacgggagggagcagccacggccagctcagattggtgtcgacagcttagtggtgtctgattttatacatgacaaaatgaacgagttaaccatttaagccaaaaaaataagactagcgtaacccaaagaaagtatttaaatacttctgtcaattaggacagttgagaaaagagaataacaaaatcaaaagcaaaactcaaactttgtacctgaaaaatctaataaaactgactaatttatagaaaacctaagaaactccatatcaaataaaaaattttaaatatgagagaa

SEQ ID NO: 17325 - DNA, 574 bp, Homo sapiens
aaggaactcagtgaccacagacggatgagaacagcggacgcagctgcctcccaggcactcaaaggctcaactccccacaggcgtgtgttgccaggggcagaaggcttggcccctgggtcagcatactctccggacagctcatccctgccagcccagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataat

SEQ ID NO: 17326 - DNA, 3617 bp, Homo sapiens
gacatcgaatcggaggccctgggaggagcagccggctggctgccctgcagaggccaggtctgcccagcaaacccaggaaggtgtggcgtccccgcttcgcggccaagatggtgctggtgctgcgccatcctttgtgtgcccgggaagggcgttccgggagccgggtcgggggctcctgactcgcactgggcagcatgacggtgcgccggctgtcactgctgtgccgggacctctgggcgctgtggctgctgctgaaggccggcgcagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtg

SEQ ID NO: 17327 - DNA, 898 bp, Homo sapiens
caatcctgggcagggaggcggcggctggaggctgaaagcgctgccgtggccccctccccgcctccgccgcgccccctccgcactcgcacggccccacccgcaggcgccccccgtgcggaggaagcggatctgccaggatcatttttgttgtgtcggaggatgaggttttggctgaggactgaagagatggccttggaagaaatggtgcagagattaaatgcggtttccaagcacacggatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagaga

SEQ ID NO: 17328 - DNA, 3602 bp, Homo sapiens
cctcaagttcctctcgggcgggcacggtgtgtcgcctggacctgcatgtaaacatcagggcggagcaggaatcggcctccaggagggtaattgcctggcgtactctgtcccaggtagtgggtgaaatgaaagtaaaaagccagctggtccctcatgcagattttaggggacaaagttcagcatagaaaggtcctgttacaaggagagggttgtggcgagcccagggcagcgcgcgtcctccccggcagctgatcctcgccatgggggacggaaaggctgtccggatttccgtggcggaaatgaaaagctactacctgtattctgagtggtgctcctggctgctgtccgtggctgaggatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcaggtaaggcccacgtgccccgagcccacccgtga

SEQ ID NO: 17329 - DNA, 4590 bp, Homo sapiens
ttgaagatgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgc

SEQ ID NO: 17330 - DNA, 3424 bp, Homo sapiens
ctgcagcctcatgtttgactgttggagatttatcctgtgcaagagacctggaagcaacagttattcttccccacaacggcccaatgaggccaaaaaggaggaaacggatcaccaaattgatgtgtctgacgtcatcaggcttgttcaagacacaccggaggcgacggccatggccacagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcaggtaaggcccacgtgccccgagcccacccgtga

SEQ ID NO: 17331 - DNA, 5067 bp, Homo sapiens
atgaggttttggctgaggactgaagagatggccttggaagaaatggtgcagagattaaatgcggtttccaagcacacggatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgc

SEQ ID NO: 17332 - DNA, 2539 bp, Homo sapiens
gtgccctcgcgcgacgcgaaggttgtcgggatccgcggcagcagcggctgcttgagatctgtttctggggcctctggcggtggcggcctggggcggcgcgacggctggtgcgcaggtacactgatgctgaagtactatgagccttcggaacttgtggagagactacaaagttttggttgttatggtccctttagttgggctcatacatttggggtggtacagaatcaaaagcagccctgttttccaaatacctaaaaacgacgacattcctgagcaagatagtctgggactttcaaatcttcagaagagccaaatccaggggaagtagcaggcttgcaatcttcaggtaaagaagcagctttgaatctgagcttcatatcgaaagaagagatgaaaaataccagttggattagaaagaactggcttcttgtagctgggatatctttcataggtgtccatcttggaacatactttttgcagaggtctgcaaagcagtctgtaaaatttcagtctcaaagcaaacaaaagagtattgaagagtgaagtaaaataaatatttggaattactaatttgtcattaaatcattctatgctgattagcttcataaacattgaactttttgattttatagccacaatgctgcatattcatactttaattcctaaagaataatttttaatgttaaaacgtgataatgcaataaatagaaaaatgtggtttacaaaataaaaacggtcttcactagttaccacctgaagtaagatgtctcgtttggaagctaagaagccatcattgtgtaagagtgaaccactgacaactgagagagtcaggaccacactttctgtcttgaaaagaattgtaacatcatgctatggcccctcaggtaggctgaagcagctgcacaatggctttggaggttacgtgtgtacaacctcacagtcctcagctctgctcagtcaccttttggtcacacatcccattttaaagatcctgacagcctccatacagaatcatgtgtcaagcttcagtgattgtggcttattcacagctattctttgctgcaacctgattgaaaatgttcagagattaggcttgacacccaccactgtcattagattaaataaacatcttttgagtctttgcatcagttatctcaagtctgagacctgtggttgtcgaatcccagtggactttagtagtactcagatcctcctttgtttggtgcgtagtatattaacaagtaaacctgcctgtatgctcaccagaaaggaaacagagcatgtcagtgctttgatcctgagagcctttttgcttacaattccagaaaatgctgaaggccacatcattttaggaaagagtttaattgtacctttaaaaggtcaaagagttatagattccactgtattacctgggatactcattgaaatgtcagaagttcaattaatgaggctattacctatcaaaaaatcaactgccctcaaggtggcactcttttgtacaactttatccggagacacttctgacactggagaaggaactgtggtggtcagttatggggtttctcttgaaaatgcagtcttggaccagctgcttaacctaggaaggcagctaatcagtgaccacgtagatcttgtcctgtgccaaaaagttatacatccatctttgaagcagtttctcaatatgcatcgtattattgccatagacagaattggagtgactctgatggaacccctgactaaaatgacaggaacacagcctattggatccctaggctcaatatgtcctaatagttatggaagtgtgaaagatgtgtgcactgcaaaatttggctccaaacatttttttcatcttattcctaatgaagcaacaatctgcagcttgcttctctgcaacagaaatgacactgcctgggatgagctgaagctcacgtgtcagacggcactgcatgtcctgcagttaacactcaaggaaccatgggctttgttgggaggtggctgtactgaaactcatttggctgcatatatcagacacaagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaagagaatagcatgttcgtattacaagagaaacaaataaactagtctgttggcaattgagaaaaa

SEQ ID NO: 17333 - DNA, 2663 bp, Homo sapiens
gggaaaacactttaggttgagtgctgagagaaaggctctctgagtaggtgacatctgaactaagagctgaagcagaagaataagccatcctctgtggaccaaaggggacaagattctctacttttctgctacgcactaggaatatagcagagaagacaagtggctgctaccttctgttatcgtgggtggcagtgactagtttttctagatcttgactccctgccgtaactaaagatggagtacactgatgctgaagtactatgagccttcggaacttgtggagagactacaaagttttggttgttatggtccctttagttgggctcatacatttggggtggtacagaatcaaaagcagccctgttttccaaatacctaaaaacgacgacattcctgagcaagatagtctgggactttcaaatcttcagaagagccaaatccaggggaagtagcaggcttgcaatcttcaggtaaagaagcagctttgaatctgagcttcatatcgaaagaagagatgaaaaataccagttggattagaaagaactggcttcttgtagctgggatatctttcataggtgtccatcttggaacatactttttgcagaggtctgcaaagcagtctgtaaaatttcagtctcaaagcaaacaaaagagtattgaagagtgaagtaaaataaatatttggaattactaatttgtcattaaatcattctatgctgattagcttcataaacattgaactttttgattttatagccacaatgctgcatattcatactttaattcctaaagaataatttttaatgttaaaacgtgataatgcaataaatagaaaaatgtggtttacaaaataaaaacggtcttcactagttaccacctgaagtaagatgtctcgtttggaagctaagaagccatcattgtgtaagagtgaaccactgacaactgagagagtcaggaccacactttctgtcttgaaaagaattgtaacatcatgctatggcccctcaggtaggctgaagcagctgcacaatggctttggaggttacgtgtgtacaacctcacagtcctcagctctgctcagtcaccttttggtcacacatcccattttaaagatcctgacagcctccatacagaatcatgtgtcaagcttcagtgattgtggcttattcacagctattctttgctgcaacctgattgaaaatgttcagagattaggcttgacacccaccactgtcattagattaaataaacatcttttgagtctttgcatcagttatctcaagtctgagacctgtggttgtcgaatcccagtggactttagtagtactcagatcctcctttgtttggtgcgtagtatattaacaagtaaacctgcctgtatgctcaccagaaaggaaacagagcatgtcagtgctttgatcctgagagcctttttgcttacaattccagaaaatgctgaaggccacatcattttaggaaagagtttaattgtacctttaaaaggtcaaagagttatagattccactgtattacctgggatactcattgaaatgtcagaagttcaattaatgaggctattacctatcaaaaaatcaactgccctcaaggtggcactcttttgtacaactttatccggagacacttctgacactggagaaggaactgtggtggtcagttatggggtttctcttgaaaatgcagtcttggaccagctgcttaacctaggaaggcagctaatcagtgaccacgtagatcttgtcctgtgccaaaaagttatacatccatctttgaagcagtttctcaatatgcatcgtattattgccatagacagaattggagtgactctgatggaacccctgactaaaatgacaggaacacagcctattggatccctaggctcaatatgtcctaatagttatggaagtgtgaaagatgtgtgcactgcaaaatttggctccaaacatttttttcatcttattcctaatgaagcaacaatctgcagcttgcttctctgcaacagaaatgacactgcctgggatgagctgaagctcacgtgtcagacggcactgcatgtcctgcagttaacactcaaggaaccatgggctttgttgggaggtggctgtactgaaactcatttggctgcatatatcagacacaagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaagagaatagcatgttcgtattacaagagaaacaaataaactagtctgttggcaattgagaaaaa

SEQ ID NO: 17334 - DNA, 2918 bp, Homo sapiens
gctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtccgagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttactcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacgtgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacgttttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtg

SEQ ID NO: 17335 - DNA, 2718 bp, Homo sapiens
acactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtccgagtcttgtaattcctccgtggggcgaaagtacccatgggctggacttagatcagatcaattaggaaatcaaggcagatgtagaaccaagatccagcacagtgacatctcatcccttctcatcttggtctgctccacataagagaagctttgtgaaaagttccaaattttgacagtaccagggcccattgttctgttaagtagcacaggaaagtaattagaaacgaggcagcatgtactgcctggcctgccaggtctatcacgttgcaattctagtgacttttgttaggataactggaacattttgtgaccccctgatttttaattttttgttatggtcaaatttttaatgcttttaaaagcaaaattaaatattttatgttgaaaagctgtacttttaaaatcctataatctgaaggatattgtgtgtatatataggtacatatatctgaactaaatttaaaatttcatttctcctccacaagtgttcttaaaagttgtctttgtaactttttgctttagtagctactatttttgtataccgtgttttgtaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttactcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatggggtaggcatattcactgcatttcttttcaaaagcatagaattcttcattggtttcattgtcatttctgtaatattacattttgtgtttcagaattttccattgttgttttcttgtctaatgtctataagaatagttgataacaggctgttgactttagttattgtgaattagttctattctgactactcgctattttgtagtagttgtactatgataatctgtttattggatggacctcctgcgtctggattttattcatcatatattagcacctgagtcctaagggagagatcaagttgagacagagaagggaagtaggcccttacttctggcagggtgctgagctgacttctacctagccccttttcagtttcttatcgtgtacaagaagacaaacagaaattcaattgatgaaatgcaaaaggaaggagagctctggctgtctctcagagatcttgcatttctgctctcttatgtcacagctggcctgcagcaggtccctgtgagcacataagcagaggctgcaggaacttgtgtggggatctcaatgctttccacatttctttctccattctgttccactgctcttctctggttcatgtccaccactgactgggaccctgaagaggcatttcagagtgttggagaagaatctgtagcttgttgaaaaagctgggggtgaaagggaacaaggaaggtgatgtgtgagtctggcaggcaggagaaggggtgttcatagaagcagtgtgcaggtgaggcaaagtgctgggactttttggtaatagatttaattatgaatgattagtaggaaaggactgagagtattatatttttcctgggatgcctaatagtcctttgatagaaaggaattttaaatagtttgacacttgaaaaaagatactatttataagttgaagaaagtttgctgtaccacaatgcgcatgtagttaacaattttgcactgtagatttaacattttgttaagaggatagatttcatgttatgcattttttaccacaatttttaaaaagtttgaatagaaatttttaatgtctttgagtggattttgttttttgaacagttggatagacttctgcgtaagaaagctggattgactgttgttccttcatataatgccttgagaaattctgaatatcaaaggcagtttgtttggaagacttctaaagaaactgctccagcttttgcagccaatcaggtagcttaatggatgtaatacatttctgagtaccattatcttatctagtaatgtagatttacatagaattaagagttgaaagaaattaagtacttaagtagcctggaggtaggttctagaaaaccaaaatgagagttttgctaaaatcatcctattacttatgatttatggtagtaatattatactgtcctaggcttctgatgatcattgttgccagatgcagcacatatactaaatatgagacagggtaatgaaaacttggggaactggtaagtttttgcatgctacaagatttttttacttattaaaaaattattaaattgattttattctaaaatgttgtgttttgttgactaatatattgcgtgtttcctgtattctaagaaaggcgtaactgctttgaatatttaataaatacaaaatatgttgacagtaa

SEQ ID NO: 17336 - DNA, 2170 bp, Homo sapiens
aagcgcggagtgcgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtccgagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttactcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatggggtaggcatattcactgcatttcttttcaaaagcatagaattcttcattggtttcattgtcatttctgtaatattacattttgtgtttcagaattttccattgttgttttcttgtctaatgtctataagaatagttgataacaggctgttgactttagttattgtgaattagttctattctgactactcgctattttgtagtagttgtactatgataatctgtttattggatggacctcctgcgtctggattttattcatcatatattagcacctgagtcctaagggagagatcaagttgagacagagaagggaagtaggcccttacttctggcagggtgctgagctgacttctacctagccccttttcagtttcttatcgtgtacaagaagacaaacagaaattcaattgatgaaatgcaaaaggaaggagagctctggctgtctctcagagatcttgcatttctgctctcttatgtcacagctggcctgcagcaggtccctgtgagcacataagcagaggctgcaggaacttgtgtggggatctcaatgctttccacatttctttctccattctgttccactgctcttctctggttcatgtccaccactgactgggaccctgaagaggcatttcagagtgttggagaagaatctgtagcttgttgaaaaagctgggggtgaaagggaacaaggaaggtgatgtgtgagtctggcaggcaggagaaggggtgttcatagaagcagtgtgcaggtgaggcaaagtgctgggactttttggtaatagatttaattatgaatgattagtaggaaaggactgagagtattatatttttcctgggatgcctaatagtcctttgatagaaaggaattttaaatagtttgacacttgaaaaaagatactatttataagttgaagaaagtttgctgtaccacaatgcgcatgtagttaacaattttgcactgtagatttaacattttgttaagaggatagatttcatgttatgcattttttaccacaatttttaaaaagtttgaatagaaatttttaatgtctttgagtggattttgttttttgaacagttggatagacttctgcgtaagaaagctggattgactgttgttccttcatataatgccttgagaaattctgaatatcaaaggcagtttgtttggaagacttctaaagaaactgctccagcttttgcagccaatcaggtagcttaatggatgtaatacatttctgagtaccattatcttatctagtaatgtagatttacatagaattaagagttgaaagaaattaagtacttaagtagcctggaggtaggttctagaaaaccaaaatgagagttttgctaaaatcatcctattacttatgatttatggtagtaatattatactgtcctaggcttctgatgatcattgttgccagatgcagcacatatactaaatatgagacagggtaatgaaaacttggggaactggtaagtttttgcatgctacaagatttttttacttattaaaaaattattaaa

SEQ ID NO: 17337 - DNA, 2472 bp, Homo sapiens
agttaactgtcggagtagcgggggctccggcgccgggcgacatgccggtgcgcttcaaggggctgagtgaataccagaggaacttcctgtggaaaaagtcttatttgtccgagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttactcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatggggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcagggttctctaaatgccatgtggtatgctgaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacgtgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacgttttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgt

SEQ ID NO: 17338 - DNA, 3059 bp, Homo sapiens
gatgtggaagccgagacctaaagttggggggtgatctctgaggagatggatcggtacctgctgctggtgatctggggggaaggaaaattcccgtcggcggccagtagggaggcagaacatgggccagaggtgtcgtcgggtgagggtactgagaatcagccggacttcacagcagcaaatgtttatcacctcttgaaaagaagcattagtgcttcaattaatccagaagatagtactttccctgcctgttcagtgggaggtatacctggttccaagaagtggttctttgcagtgcaggcaatatatggattttatcagttttgtagttctgattggcaagagatacattttgatacagaaaaagataaaattgaagatgttcttcaaacgaatatcgaagaatgtttgggtgctgttgagtgttttgaagaagaagacagtaatagcagggaatcattatccttggctgatctctatgaagaagctgcagaaaatttgcatcagctgtcagacaagcttcctgctcctggtagagcaatggtagatataatactgttgctttctgacaaagatcctcctaaattgaaagactatttacctactgtaggagcattaaaacatttgagagaatggtattcagcaaagatcactatagcaggaaatcattgtgaaataaactgtcagaaaattgcagaatacctttctgctaatgttgtatctttagaagatctcagaaatgttattgactcaaaggaattatggagggggaaaatacagatatgggaaagaaagtttggatttgaaattagttttcctgaattttgtttaaagggagtcacacttaagaattttagtacttctaatttaaatactgacttccttgccaaaaagatcataccatcaaaggataagaatattttgccaaaggttttccattattatggccctgctttagaatttgtgcagatgataaaattatcagatctaccctcctgctatatgtcggatattgaatttgagttaggattgacaaacagtaccaaacagaattctgtgttgctgttggagcagatttcttctctgtgtagcaaggttggtgctctttttgtattgccatgtaccattagtaacatactgattccacctcccaaccaactcagttcaagaaaatggaaggaatatatagctaaaaagcctaaaacaatcagtgttccagatgttgaagtgaaaggagagtgttctagctattatctcttgttacaaggtaatggcaatagaagatgtaaagccacattgattcactcagccaaccagatcaatggctcatttgcactcaatttaattcatggaaagatgaaaacaaagacagaagaagccaaattgagttttccttttgacttattatcacttccacatttttctggggagcagattgtacagagagagaaacagttagctaatgttcaagttttagctttggaagaatgcctaaaaagacgaaagttggcaaagcagcctgaaacagtttctgttgctgaactcaaaagtctgttagtactcacaaggaaacactttttagattattttgatgctgtgattcctaaaatgattctaagaaagatggacaaaattaaaaccttcaatatattaaatgattttagtccagtggaacctaattcctcaagtctaatggaaaccaatcctctggaatggccagaaaggcatgttcttcaaaatttggaaacttttgaaaaaactaaacaaaaaatgagaactggttcattacctcattcatctgaacagttgctgggccacaaagagggtcctcgggactcaatcacattgttggatgctaaagaattgctgaagtactttacctcagatggattacccattggagatcttcaacctttaccgattcaaaagggggaaaagacttttgttttgacaccagaacttagtcctgggaaacttcaggtcttaccttttgagaaagcctcagtatgtcattatcatggaattgaatattgcttggatgaccgaaaagctttggaaagagatggaggattttctgaacttcagtctcgtcttattcgttatgaaactcaaactacctgcaccagagaaagttttccagtacctactgtgttgagccctcttccatctcctgtagtttcgtcagatcctggaagtgtccctgacggagaagttttacaaaatgaacttcgaactgaagtatcccgattgaaacggagatctaaagatctgaattgcctttatcccagaaaaagacttgtgaaatctgaaagttcagagtctcttctttctcagacaactggtaatagtaatcactatcatcatcatgtgacatccagaaagccacaaacagaacggtccttaccagtgacttgtccattggttccaattcctagctgtgaaactccaaaacttgctacaaagaccagttcaggtcaaaaaagtatgcatgaatcaaaaacatcaaggcaaattaaggaatcaagatcacagaaacacacacggatactgaaagaagtagttactgaaaccctgaagaaacacagtattaccgagactcatgaatgtttcactgcatgcagccagcgtctctttgaaatctctaagttctatctaaaggatcttaaaacttcaaggggtctatttgaagaaatgaagaaaacagcaaacaacaatgctgtacaggtgattgactgggtattagaaaagacaagcaagaaatgatacataatcattctctttaagacaattataaattggatggagctattattcactacttcttttcttagtttgaaaattataaacaaattttaagctttattcaaagaatagatgttatatttctaaagaatttcatgaatatatattctatatttgtatagtttgagggatgctatgttaatgtatttttaattagatacatattttgtaaagtgttactatattttaaagttatttttatatgttttaaaatgtttactcttatttaattattacaataaacagaatttttttttttt

SEQ ID NO: 17339 - DNA, 2091 bp, Homo sapiens
tcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccagggccttcatggaatcgagctcccttcagaaaaggatgcggagtgtgttggaccgtctggaagggttcagccagcagagttccattcacaatgtgctagaggccttccgtcgagcccggcgccgcatgcaggaggcccgggaaagcctcccgcaggacctagtgagcccctctggaaccctggtctcctagctcacagcagccctggcccacagtgcaagaggacaagatgggggatatctgaggccagtgctctcctgcctcttcgtctttctgattagagaccacgttggtctgctgagaaccagaaaagctgggaaattcccggctggcccctctgcctagccttctgcagggtcttctccctaccctgtggaaataaagccagagaccctgtggccccccctttatatttgcagccactgtcaatgggcatcacagcaaggcaggctttttgatctgaagctgtttggggtgaccccatagtgagtctggccttgactcacttttctggcttgtctcacagtagcaggggatctgctgttctccaccctttaaaaatggagcctttcatcttccaagaccaaagaaggaaggaaggtggacggtgagagggtcttaaatccccagcctgtgagtctcagcctctttccagggaagcctcattctactgcttggggcttgctgaggttgagatatgagttatttctgagtaagtgaaggctgaaggcagtgctgagtcctttctgctagctgggtggtatcttttactgtgtttttttgtttgtttgtttttttgttttttgttacataaaccc

SEQ ID NO: 17340 - DNA, 1576 bp, Homo sapiens
cgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggctcacacaccctgacagtctccacgtggagacctgtggagcttggcacggtggctgagctgaggaggtttttcattggcggttctctggaactggaggacctctcctatgtacggataccaggatccttcaaggcactcctttcatcttccaagaccaaagaaggaaggaaggtggacggtgagagggtcttaaatccccagcctgtgagtctcagcctctttccagggaagcctcattctactgcttggggcttgctgaggttgagatatgagttatttctgagtaagtga

SEQ ID NO: 17341 - DNA, 2392 bp, Homo sapiens
ccgatccagcgtctccgttgccaggaaaacagagcggcgcgctttccggcgcagtcgcggcgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggctcacacaccctgacagtctccacgtggagacctgtggagcttggcacggtggctgagctgaggaggtttttcattggcggttctctggaactggaggacctctcctatgtacggataccaggatccttcaagggggaacgcctgagccgctttggactccgcacagagaccacaggcactgtcaccttccgcttgcactgtctgcagcagtccagggccttcatggaatcgagctcccttcagaaaaggatgcggagtgtgttggaccgtctggaagggttcagccagcagagttccattcacaatgtgctagaggccttccgtcgagcccggcgccgcatgcaggaggcccgggaaagcctcccgcaggacctagtgagcccctctggaaccctggtctcctagctcacagcagccctggcccacagtgcaagaggacaagatgggggatatctgaggccagtgctctcctgcctcttcgtctttctgattagagaccacgttggtctgctgagaaccagaaaagctgggaaattcccggctggcccctctgcctagccttctgcagggtcttctccctaccctgtggaaataaagccagagaccctgtggccccccctttatatttgcagccactgtcaatgggcatcacagcaaggcaggctttttgatctgaagctgtttggggtgaccccatagtgagtctggccttgactcacttttctggcttgtctcacagtagcaggggatctgctgttctccaccctttaaaaatggagcctttcatcttccaagaccaaagaaggaaggaaggtggacggtgagagggtcttaaatccccagcctgtgagtctcagcctctttccagggaagcctcattctactgcttggggcttgctgaggttgagatatgagttatttctgagtaagtgaaggctgaaggcagtgctgagtcctttctgctagctgggtggtatcttttactgtgtttttttgtttgtttgtttttttgttttttgttacataaaccccttttattttg

SEQ ID NO: 17342 - DNA, 1748 bp, Homo sapiens
ccgatccagcgtctccgttgccaggaaaacagagcggcgcgctttccggcgcagtcgcggcgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggctcacacaccctgacagtctccacgtggagacctgtggagcttggcacggtggctgagctgaggaggtttttcattggcggttctctggaactggaggacctctcctatgtacggataccaggatccttcaagggcctttcatcttccaagaccaaagaaggaaggaaggtggacggtgagagggtcttaaatccccagcctgtgagtctcagcctctttccagggaagcctcattctactgcttggggcttgctgaggttgagatatgagttatttctgagtaagtgaaggctgaaggcagtgctgagtcctttctgctagctgggtggtatcttttactgtgtttttttgtttgtttgtttttttgttttttgttacataaaccccttttattttga

SEQ ID NO: 17343 - DNA, 2385 bp, Homo sapiens
agtgtggcatggtggaaaaggtagagggcgaagactcaggccacctggtccccgtcatcatttctgcatctatctgtctatatgaagtgggctgatggctgtgccagtttcctcatttgcacagcgcacgaggtcccgctttcgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggctcacacaccctgacagtctccacgtggagacctgtggagcttggcacggtggctgagctgaggaggtttttcattggcggttctctggaactggaggacctctcctatgtacggataccaggatccttcaagggggaacgcctgagccgctttggactccgcacagagaccacaggcactgtcaccttccgcttgcactgtctgcagcagtccagggccttcatggaatcgagctcccttcagaaaaggatgcggagtgtgttggaccgtctggaagggttcagccagcagagttccattcacaatgtgctagaggccttccgtcgagcccggcgccgcatgcaggaggcccgggaaagcctcccgcaggacctagtgagcccctctggaaccctggtctcctagctcacagcagccctggcccacagtgcaagaggacaagatgggggatatctgaggccagtgctctcctgcctcttcgtctttctgattagagaccacgttggtctgctgagaaccagaaaagctgggaaattcccggctggcccctctgcctagccttctgcagggtcttctccctaccctgtggaaataaagccagagaccctgtggccccccctttatatttgcagccactgtcaatgggcatcacagcaaggcaggctttttgatctgaagctgtttggggtgaccccatagtgagtctggccttgactcacttttctggcttgtctcacagtagcaggggatctgctgttctccaccctttaaaaatggagcctttcatcttccaagaccaaagaaggaaggaaggtggacggtgagagggtcttaaatccccagcctgtgagtctcagcctctttccagggaagcctcattctactgcttggggcttgctgaggttgagatatgagttatttctgagtaagtgaaggctgaaggcagtgctgagtcctttctgctagctgggtggtatcttttactgtgtttttttgtttgtttgtttttttgttttttgttacataaaccccttttattttgactg

SEQ ID NO: 17344 - DNA, 1926 bp, Homo sapiens
gctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggctcacacaccctgacagtctccacgtggagacctgtggagcttggcacggtggctgagctgaggaggtttttcattggcggttctctggaactggaggacctctcctatgtacggataccaggatccttcaagggggaacgcctgagccgctttggactccgcacagagaccacaggcactgtcaccttccgcttgcactgtctgcagcagtccagggccttcatggaatcgagctcccttcagaaaaggatgcggagtgtgttggaccgtctggaagggttcagccagcagagttccattcacaatgtgctagaggccttccgtcgagcccggcgccgcatgcaggaggcccgggaaagcctcccgcaggacctagtgagcccctctggaaccctggtctcctagctcacagcagccctggcccacagtgcaagaggacaagatgggggatatctgaggccagtgctctcctgcctcttcgtctttctgattagagaccacgttggtctgctgagaaccagaaaagctgggaaattcccggctggcccctctgcctagccttctgcagggtcttctccctaccctgtggaaataaagccagagaccctgtggccccccctttatatttgcagccactgtcaatgggcatcacagcaaggcaggctttttgatctgaagctgtttggggtgaccccatagtgagtctggccttgactcacttttctggcttgtctcacagtagc

SEQ ID NO: 17345 - DNA, 5826 bp, Homo sapiens
tttgggaagttccgttggggaagatggcggcggcctcgagcacccttctcttcttgccgccggggacttcagattgatccttcccgggaagagtagggactgctggtgccctgcgtcccgggatcccgagccaacttgtttcctccgttagtggtggggaagggcttatccttttgtggcggatctagcttctcctcgccttcaggatgaaagctcagggggaaaccgaggagtcagaaaagctgagtaagatgagttctctcctggaacggctccatgcaaaatttaaccaaaatagaccctggagtgaaaccattaagcttgtgcgtcaagtcatggagaagagggttgtgatgagttctggagggcatcaacatttggtcagctgtttggagacattgcagaaggctctcaaagtaacatctttaccagcaatgactgatcgtttggagtccatagcaagacagaatggactgggctctcatctcagtgccagtggcactgaatgttacatcacgtcagatatgttctatgtggaagtgcagttagatcctgcaggacagctttgtgatgtaaaagtggctcaccatggggagaatcctgtgagctgtccggagcttgtacagcagctaagggaaaaaaattttgatgaattttctaagcaccttaagggccttgttaatctgtataaccttccaggggacaacaaactgaagactaaaatgtacttggctctccaatccttagaacaagatctttctaaaatggcaattatgtactggaaagcaactaatgctggtcccttggataagattcttcatggaagtgttggctatctcacaccaaggagtgggggtcatttaatgaacctgaagtactatgtctctccttctgacctactggatgacaagactgcatctcccatcattttgcatgagaataatgtttctcgatctttgggcatgaatgcatcagtgacaattgaaggaacatctgctgtgtacaaactcccaattgcaccattaattatggggtcacatccagttgacaataaatggaccccttccttctcctcaatcaccagtgccaacagtgttgatcttcctgcctgtttcttcttgaaatttccccagccaatcccagtatctagagcatttgttcagaaactgcagaactgcacaggaattccattgtttgaaactcaaccaacttatgcacccctgtatgaactgatcactcagtttgagctatcaaaggaccctgaccccatacctttgaatcacaacatgagattttatgctgctcttcctggtcagcagcactgctatttcctcaacaaggatgctcctcttccagatggccgaagtctacagggaacccttgttagcaaaatcacctttcagcaccctggccgagttcctcttatcctaaatctgatcagacaccaagtggcctataacaccctcattggaagctgtgtcaaaagaactattctgaaagaagattctcctgggcttctccaatttgaagtgtgtcctctctcagagtctcgtttcagcgtatcttttcagcaccctgtgaatgactccctggtgtgtgtggtaatggatgtgcaggactcaacacatgtgagctgtaaactctacaaagggctgtcggatgcactgatctgcacagatgacttcattgccaaagttgttcaaagatgtatgtccatccctgtgacgatgagggctattcggaggaaagctgaaaccattcaagccgacaccccagcactgtccctcattgcagagacagttgaagacatggtgaaaaagaacctgcccccggctagcagcccagggtatggcatgaccacaggcaacaacccaatgagtggtaccactacaccaaccaacacctttccggggggtcccattaccaccttgtttaatatgagcatgagcatcaaagatcggcatgagtcggtgggccatggggaggacttcagcaaggtgtctcagaacccaattcttaccagtttgttgcaaatcacagggaacggggggtctaccattggctcgagtccgacccctcctcatcacacgccgccacctgtctcttcgatggccggcaacaccaagaaccacccgatgctcatgaaccttcttaaagataatcctgcccaggatttctcaaccctttatggaagcagccctttagaaaggcagaactcctcttccggctcaccccgcatggaaatatgctcggggagcaacaagaccaagaaaaagaagtcatcaagattaccacctgagaaaccaaagcaccagactgaagatgactttcagagggagctattttcaatggatgttgactcacagaaccctatctttgatgtcaacatgacagctgacacgctggatacgccacacatcactccagctccaagccagtgtagcactcccccaacaacttacccacaaccagtacctcacccccaacccagtattcaaaggatggtccgactatccagttcagacagcattggcccagatgtaactgacatcctttcagacattgcagaagaagcttctaaacttcccagcactagtgatgattgcccagccattggcacccctcttcgagattcttcaagctctgggcattctcagagtaccctgtttgactctgatgtctttcaaactaacaataatgaaaatccatacactgatccagctgatcttattgcagatgctgctggaagccccagtagtgactctcctaccaatcatttttttcatgatggagtagatttcaatcctgatttattgaacagccagagccaaagtggttttggagaagaatattttgatgaaagcagccaaagtggggataatgatgatttcaaaggatttgcatctcaggcactaaatactttgggggtgccaatgcttggaggtgataatggggagaccaagtttaagggcaataaccaagccgacacagttgatttcagtattatttcagtagccggcaaagctttagctcctgcagatcttatggagcatcacagtggtagtcagggtcctttactgaccactggggacttagggaaagaaaagactcaaaagagggtaaaggaaggcaatggcaccagtaatagtactctctcggggcccggattagacagcaaaccagggaagcgcagtcggaccccttctaatgatgggaaaagcaaagataagcctccaaagcggaagaaggcagacactgagggaaagtctccatctcatagttcttctaacagaccttttaccccacctaccagtacaggtggatctaaatcgccaggcagtgcaggaagatctcagactcccccaggtgttgccacaccacccattcccaaaatcactattcagattcctaagggaacagtgatggtgggcaagccttcctctcacagtcagtataccagcagtggttctgtgtcttcctcaggcagcaaaagccaccatagccattcttcctcctcttcctcatctgcttccacctcagggaagatgaaaagcagtaaatcagaaggttcatcaagttccaagttaagtagcagtatgtattctagccaggggtcttctggatctagccagtccaaaaattcatcccagtctggggggaagccaggctcctctcccataaccaagcatggactgagcagtggctctagcagcaccaagatgaaacctcaaggaaagccatcatcacttatgaatccttctttaagtaaaccaaacatatccccttctcattcaaggccacctggaggctctgacaagcttgcctctccaatgaagcctgttcctggaactcctccatcctctaaagccaagtcccctatcagttcaggttctggtggttctcatatgtctggaactagttcaagctctggcatgaagtcatcttcagggttaggatcctcaggctcgttgtcccagaaaactcccccatcatctaattcctgtacggcatcttcctcctccttttcctcaagtggctcttccatgtcatcctctcagaaccagcatgggagttctaaaggaaaatctcccagcagaaacaagaagccgtccttgacagctgtcatagataaactgaagcatggggttgtcaccagtggccctgggggtgaagacccactggacggccagatgggggtgagcacaaattcttccagccatcctatgtcctccaaacataacatgtcaggaggagagtttcagggcaagcgtgagaaaagtgataaagacaaatcaaaggtttccacctccgggagttcagtggattcttctaagaagacctcagagtcaaaaaatgtggggagcacaggtgtggcaaaaattatcatcagtaagcatgatggaggctcccctagcattaaagccaaagtgactttgcagaaacctggggaaagtagtggagaagggcttaggcctcaaatggcttcttctaaaaactatggctctccactcatcagtggttccactccaaagcatgagcgtggctctcccagccatagtaagtcaccagcatataccccccagaatctggacagtgaaagtgagtcaggctcctccatagcagagaaatcttatcagaatagtcccagctcagacgatggtatccgaccacttccagaatacagcacagagaaacataagaagcacaaaaaggaaaagaagaaagtaaaagacaaagatagggaccgagaccgggacaaagaccgagacaagaaaaaatctcatagcatcaagccagagagttggtccaaatcacccatctcttcagaccagtccttgtctatgacaagtaacacaatcttatctgcagacagaccctcaaggctcagcccagactttatgattggggaggaagatgatgatcttatggatgtggccctgattgggaattaggaaccttatttcctaaaagaaacagggccagaggaaaaaaaactattgataagtttataggcaaaccaccataaggggtgagtcagacaggtctgatttggttaagaatcctaaatggcatggctttgacatcaagctgggtgaattagaaaggcatatccagaccctattaaagaaaccacagggtttgattctggttaccaggaagtcttctttgttcctgtgccagaaagaaagttaaaatacttgcttaagaaagggaggggggtgggaggggtgtagggagagggaagggagggaaacagttttgtgggaaatattcatatatattttcttctccctttttccatttttaggccatgttttaaactcattttagtgcatgtatatgaagggctgggcagaaaatgaaaaagcaatacattccttgatgcatttgcatgaaggttgttcaactttgtttgaggtagttgtccgtttgagtcatgggcaaatgaaggactttggtcattttggacacttaagtaatgtttggtgtctgtttcttaggagtgactgggggagggaagattattttagctatttatttgtaatattttaaccctttatctgtttgtttttatacagtgtttcgttctaaatctatgaggtttagggttcaaaatgatggaaggccgaagagcaaggcttatatggtggtagggagcttatagcttgtgctaatactgtagcatcaagcccaagcaaattagtcagagcccgcctttagagttaaatataatagaaaaaccaaaatgatatttttattttaggagggtttaaatagggttcagagatcataggaatattaggagttacctctctgtggaggtat

SEQ ID NO: 17346 - DNA, 2870 bp, Homo sapiens
tttgggaagttccgttggggaagatggcggcggcctcgagcacccttctcttcttgccgccggggacttcagattgatccttcccgggaagagtagggactgctggtgccctgcgtcccgggatcccgagccaacttgtttcctccgttagtggtggggaagggcttatccttttgtggcggatctagcttctcctcgccttcaggatgaaagctcagggggaaaccgaggagtcagaaaagctgagtaagatgagttctctcctggaacggctccatgcaaaatttaaccaaaatagaccctggagtgaaaccattaagcttgtgcgtcaagtcatggagaagagggttgtgatgagttctggagggcatcaacatttggtcagctgtttggagacattgcagaaggctctcaaagtaacatctttaccagcaatgactgatcgtttggagtccatagcaagacagaatggactgggctctcatctcagtgccagtggcactgaatgttacatcacgtcagatatgttctatgtggaagtgcagttagatcctgcaggacagctttgtgatgtaaaagtggctcaccatggggagaatcctgtgagctgtccggagcttgtacagcagctaagggaaaaaaattttgatgaattttctaagcaccttaagggccttgttaatctgtataaccttccaggggacaacaaactgaagactaaaatgtacttggctctccaatccttagaacaagatctttctaaaatggcaattatgtactggaaagcaactaatgctggtcccttggataagattcttcatggaagtgttggctatctcacaccaaggagtgggggtcatttaatgaacctgaagtactatgtctctccttctgacctactggatgacaagactgcatctcccatcattttgcatgagaataatgtttctcgatctttgggcatgaatgcatcagtgacaattgaaggaacatctgctgtgtacaaactcccaattgcaccattaattatggggtcacatccagttgacaataaatggaccccttccttctcctcaatcaccagtgccaacagtgttgatcttcctgcctgtttcttcttgaaatttccccagccaatcccagtatctagagcatttgttcagaaactgcagaactgcacaggaattccattgtttgaaactcaaccaacttatgcacccctgtatgaactgatcactcagtttgagctatcaaaggaccctgaccccatacctttgaatcacaacatgagattttatgctgctcttcctggtcagcagcactgctatttcctcaacaaggatgctcctcttccagatggccgaagtctacagggaacccttgttagcaaaatcacctttcagcaccctggccgagttcctcttatcctaaatctgatcagacaccaagtggcctataacaccctcattggaagctgtgtcaaaagaactattctgaaagaagattctcctgggcttctccaatttgaagtgtgtcctctctcagagtctcgtttcagcgtatcttttcagcaccctgtgaatgactccctggtgtgtgtggtaatggatgtgcaggactcaacacatgtgagctgtaaactctacaaagggctgtcggatgcactgatctgcacagatgacttcattgccaaagttgttcaaagatgtatgtccatccctgtgacgatgagggctattcggaggaaagctgaaaccattcaagccgacaccccagcactgtccctcattgcagagacagttgaagacatggtgaaaaagaacctgcccccggctagcagcccaggatcaaagaatcccgagttaggatctggatgaaggataagcccctgaattgtcgatgggctcacccccacactgacccagcatctgaacttgcttaacagggagccggggctaaactgcttcaccctgcctgagaaccagggagcactgcatttctccacagggtggaggagaagaggcagaataaaccaagcctgggacacctccctcctgtctaggtgtactcattcttctgtttcaaaagaaggcaaggacatgaagtcaacttctacctatcttctgctgctggtgtcttatgtattctcagtttgacctgattcctcttctgtcttttgacttaacattaggggttcttggtcataacctgctctgatgtacataaagatttcaggttcaatatcaatgtgtcttaaaacagaagtattttagcgggtggggggtggggtggtggggacaaacaacgcaggatataattgccaaaaccaggcttgaggttggtgactcttgaaagattttctttcttcaggcctagatcagaaaattaagtgcagcaatatcatgaattctcagaagccctttcagggagccagtgagtcatacagtatccacagttgagtcacttaaagatgtcagtatacgaaacattattcacaatccttgggcaatctcatttttttttccttctcccctcctcccctgccccccatacatttctatccttgagttagttttggaggggcaggaagtacttaacatctcagaagctagattgggaaacatgctcagctataagaactgagctttaaattttgagtttaaaaatgtacatcaggagcagctggggagggtctttttttaaaaaaatctttcaaatttggttttctgtgcatatggccgttttgtaaatactttggggtttttcatttttttgaaagtagatgaaatctgttgtgggatttttttcccgaaacattacaaaataacctgtttatttacatgcaaataaacttctttgataaaaagtaa

SEQ ID NO: 17347 - DNA, 1141 bp, Homo sapiens
cagaggaaacggaagtcgtatctgtccggacggaagcaggaagcgggagcgtagggccacgcctgcggcgctgctggttgaggctgtgtgggtcggggacgggccgaggcgatggcggagaagtttgaccacctagaggagcacctggagaagttcgtggagaacattcggcagctcggcatcatcgtcagtgacttccagcccagcagccaggccgggctcaaccaaaagctgaattttattgttactggcttacaggatattgacaagtgcagacagcagcttcatgatattactgtaccgttagaagtttttgaatatatagatcaaggtcgaaatccccagctctacaccaaagagtgcctggagagggctctagctaaaaatgagcaagttaaaggcaagatcgacaccatgaagaaatttaaaagcctgttgattcaagaactttctaaagtatttccggaagacatggctaagtatcgaagcatccggggggaggatcacccgccttcttaaccagctcaccctccctgtgtgaagatcccctgggactgcgatgcggcgtgaggctgggactgcgagtgctgacgccaccttcctgctgaggtgggactgggccctggacacacccctcagcccctctgtcctcattgtttggcctcatgggaccgaggggctggaggagaggcggagctgtgccccagctgttccagcagcttgtctggcgtcaactggctttcagagtgctgacccctcatcactgtggggatcattctctctgagggcagatgaggcgcaggaaaatagtcttggaaatgttaaatatgatgggtaaattaaaagttttacaacattctacctaatatttttcttttaacatactctttctgttctattgtattatggtgtccgaaagctaaataacgactaggaaaaatttttttaaaaaaagaaaaatcagtttaatgtgggaagtacttaagtggtattatattttacattttcaagtatagtgcataaagaatgttttaaatgtaactgttttcatggatttcaattagacatgcctataataaactaagtatgtggcttattccatgtaattatttttgtaatataatacaatgtgtcttgtaaa

SEQ ID NO: 17348 - DNA, 822 bp, Homo sapiens
acttccggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggtactgtgatcctagaattgtccaaggaaaaaactaacgagcggctcctagaccggcaggcggcggccttcaccgcttcagtgcaacacgtggaggcggagctgtcagctcagatccgctacctcacccaggtggccacagggcagccccatgagggctccagctactcttcgaggaaggactgtcagatggctctgaagcgagtggactatgcccgcctcaagctcagtgatgtggctcgaacctgtgagcagatgctggagaactaggccagggagatggacccagagctgagagggagaccatcacctgtgccatgggacagaacctgggaacatgtagggtggggagtatgagcaccaacataccctgctggtcaaagtaccctaggacaaaggggcaaatggtgggcatggaaaaactgaagcccgagcctgcccacagctatgctttggcctctccagcagggtgctcctgctctgcactccagaaacaccctgacaggctcagagaggagatggaaactgacatacccaacccacttcctcaaacacttcatgctgctgccccagccttcccgcagacttggcctaatgaaaatacatacttcttcattcggagagacaaaacaagaactagagttttaatgataataaaagcaataataataaaagc

SEQ ID NO: 17349 - DNA, 6977 bp, Homo sapiens
attgtccgatggttcccggcgtacctcggcttccctcggtagtttccggcaatggtcgagagtttctaacgtgcccccttgttgtctctcggccgccgtcctctcaaccaccgccccccttttcggctccctctcccccttcccgttcccccagtcagcctggccctgctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccaggcaaagatacagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaaggg

SEQ ID NO: 17350 - DNA, 6795 bp, Homo sapiens
gctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgc

SEQ ID NO: 17351 - DNA, 6823 bp, Homo sapiens
ttcccgttcccccagtcagcctggccctgctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaa

SEQ ID NO: 17352 - DNA, 389 bp, Homo sapiens
ggaccccaaacagaaggaggaaaaaacaactaaacgccgctttcctgcctcaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtac

SEQ ID NO: 17353 - DNA, 6422 bp, Homo sapiens
gaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagctctctccttcttccctccagggctatactccttatgtttctcatgtgggattgcagcaacacacaggccctgcagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccc

SEQ ID NO: 17354 - DNA, 3010 bp, Homo sapiens
ggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccaggcaaagatacagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaa

SEQ ID NO: 17355 - DNA, 752 bp, Homo sapiens
aggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcag

SEQ ID NO: 17356 - DNA, 6763 bp, Homo sapiens
attgtccgatggttcccggcgtacctcggcttccctcggtagtttccggcaatggtcgagagtttctaacgtgcccccttgttgtctctcggccgccgtcctctcaaccaccgccccccttttcggctccctctcccccttcccgttcccccagtcagcctggccctgctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcagatcctacccgccacctgcaacagcggcccagtggctatgtgcaccagcaggcccccacctatggacatggactgacctccactcaaagttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctc

SEQ ID NO: 17357 - DNA, 2862 bp, Homo sapiens
gtccgctccacagcttcttcccgggaggggagggccaccctcgccttgggcgagcacttcagccaccagcctaggcgccaagaaaagtttttttttttttttttccagtgccccacccccacccccatcctgcgcccagctggggtgggtttgggtccattggtgaaaaaagtcacacgttcccatcagctgctcctccccctggagacaaggtaggggggagcagaggaggcaggcgccgcggaggaccctggccgacctctagtccctccgccgccgccaccggagcggtgcgtcccggggctcgagcgcagccgagtacccgccgaaggctgtccccatcagtgcgtgtctgctgccgggcagcggcagcatccaacctgctttattcctcctgcctgcagcgccacagcgagcgagcgagcgaggagggggagagagggagtctgtctgcaaagtgctgctccctggtgctcagaggcggctgctccagctccaactctcattcatttcgccggttaacatgagagatcatggccgccttcgggcttctcagctatgagcagagaccgctgaagcgcccccggctcgggccgcccgacgtctacccacaggaccccaagcagaaggaggatgaacttactgctgtgaatgtaaagcaaggcttcaataatcagccagccttcactggagatgaacatggctcagccagaaatattgtaattaacccatcaaagattggagcttattttagcagcatattagctgagaaactgaagcttaacactttccaggacacgggaaagaagaaaccacaagttaatgctaaagataattattggctggttactgctcgatcccagagtgcaattcatagttggttttctgacttagcaggaaataagccactttctattttggcaaaaaaggttcctatccttagtaaaaaagaggatgtttttgcatatttagctaaatattctgtgccaatggttcgagcaacgtggctgatcaagatgacttgtgcctattattctgctatatctgaagctaaaattaagaaacgtcaggctcctgatccgaatttggagtggacacagatatctaccagatatcttcgagagcagttggccaagatttctgacttttaccacatggcctccagcacgggcgatggccctgtccctgtgccaccagaggtggagcaagccatgaagcaatgggaatacaacgaaaagctagcatttcacatgttccaggaaggaatgttagaaaaacacgaatatttgacatggatcctggatgttttagaaaagatcagaccaatggatgatgatcttcttaaactcttgctaccactaatgctgcagtattcagatgagtttgttcagtcggcctacctgtctcgtcgtcttgcctacttttgtgcccggcgtctttccttgctgctgagcgatagccccaacctccttgctgcccactcaccccacatgatgataggaccaaacaactcgagtatcggggcccccagccctggcccccccggccctggcatgagccccgtgcagctggccttctcagattttctttcctgtgcacagcatggtcccctggtttatggacttagttgtatgttgcagactgtcactctctgttgcccaagtgccttggtgtggaattattccacaaatgaaaataagagcgcaaacccaggctcacccctggatctgctgcaggtggccccgtccagcctccccatgccgggtgggaacacggctttcaatcagcaggttcgggcaaggatttatgaagtagaacaacagataaaacaaagaggccgtgcagtggaagttcggtggtcatttgacaagtgccaagaatccacagcaggggtgactattagtcgggttttgcacacgttggaagttttggatcgtcactgttttgaccgaactgattccagcaattccatggagacactttatcataagattttctgggcaaaccaaaacaaagataaccaagaggttgcgcccaacgatgaagctgtggtgacgctgttatgtgaatgggccgtgagctgcaaacggtctggcaagcacagggccatggctgtggcaaaactcctggagaagaggcaagcagaaattgaggcagagagatgtggtgaatcagaagtcttagatgagaaggagtctatttcttcatcctctcttgctggatccagtttgcctgttttccagaatgtgctgttaaggtttttagatacacaggccccctctttgtcggacccaaacagtgaatgtgaaaaggtggaatttgtgaacctggtgctgctcttctgcgagttcatccgccatgatgtcttctcccatgacgcatacatgtgtaccctcatatctcgaggagatttgtcagtcactgcctcaactcggccgcggtcaccagtaggggaaaatgcagatgaacactattcaaaggaccatgatgtgaaaatggaggaacagagtattatggcgcatatgggcattgactcaggaaccactaacatttttgatgaagtagacaagagtgactttaaaactgactttggttcggaatttccaattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggtaagtcattgcttcagttaatctataccctgattattttattataagatcaataactgttgaacgtcagattattcaa

SEQ ID NO: 17358 - DNA, 2757 bp, Homo sapiens
gtccgctccacagcttcttcccgggaggggagggccaccctcgccttgggcgagcacttcagccaccagcctaggcgccaagaaaagtttttttttttttttttccagtgccccacccccacccccatcctgcgcccagctggggtgggtttgggtccattggtgaaaaaagtcacacgttcccatcagctgctcctccccctggagacaaggtaggggggagcagaggaggcaggcgccgcggaggaccctggccgacctctagtccctccgccgccgccaccggagcggtgcgtcccggggctcgagcgcagccgagtacccgccgaaggctgtccccatcagtgcgtgtctgctgccgggcagcggcagcatccaacctgctttattcctcctgcctgcagcgccacagcgagcgagcgagcgaggagggggagagagggagtctgtctgcaaagtgctgctccctggtgctcagaggcggctgctccagctccaactctcattcatttcgccggttaacatgagagatcatggccgccttcgggcttctcagctatgagcagagaccgctgaagcgcccccggctcgggccgcccgacgtctacccacaggaccccaagcagaaggaggatgaacttactgctgtgaatgtaaagcaaggcttcaataatcagccagccttcactggagatgaacatggctcagccagaaatattgtaattaacccatcaaagattggagcttattttagcagcatattagctgagaaactgaagcttaacactttccaggacacgggaaagaagaaaccacaagttaatgctaaagataattattggctggttactgctcgatcccagagtgcaattcatagttggttttctgacttagcaggaaataagccactttctattttggcaaaaaaggttcctatccttagtaaaaaagaggatgtttttgcatatttagctaaatattctgtgccaatggttcgagcaacgtggctgatcaagatgacttgtgcctattattctgctatatctgaagctaaaattaagaaacgtcaggctcctgatccgaatttggagtggacacagatatctaccagatatcttcgagagcagttggccaagatttctgacttttaccacatggcctccagcacgggcgatggccctgtccctgtgccaccagaggtggagcaagccatgaagcaatgggaatacaacgaaaagctagcatttcacatgttccaggaaggaatgttagaaaaacacgaatatttgacatggatcctggatgttttagaaaagatcagaccaatggatgatgatcttcttaaactcttgctaccactaatgctgcagtattcagatgagtttgttcagtcggcctacctgtctcgtcgtcttgcctacttttgtgcccggcgtctttccttgctgctgagcgatagccccaacctccttgctgcccactcaccccacatgatgataggaccaaacaactcgagtatcggggcccccagccctggcccccccggccctggcatgagccccgtgcagctggccttctcagattttctttcctgtgcacagcatggtcccctggtttatggacttagttgtatgttgcagactgtcactctctgttgcccaagtgccttggtgtggaattattccacaaatgaaaataagagcgcaaacccaggctcacccctggatctgctgcaggtggccccgtccagcctccccatgccgggtgggaacacggctttcaatcagcaggttcgggcaaggatttatgaagtagaacaacagataaaacaaagaggccgtgcagtggaagttcggtggtcatttgacaagtgccaagaatccacagcaggggtgactattagtcgggttttgcacacgttggaagttttggatcgtcactgttttgaccgaactgattccagcaattccatggagacactttatcataagattttctgggcaaaccaaaacaaagataaccaagaggttgcgcccaacgatgaagctgtggtgacgctgttatgtgaatgggccgtgagctgcaaacggtctggcaagcacagggccatggctgtggcaaaactcctggagaagaggcaagcagaaattgaggcagagagatgtggtgaatcagaagtcttagatgagaaggagtctatttcttcatcctctcttgctggatccagtttgcctgttttccagaatgtgctgttaaggtttttagatacacaggccccctctttgtcggacccaaacagtgaatgtgaaaaggtggaatttgtgaacctggtgctgctcttctgcgagttcatccgccatgatgtcttctcccatgacgcatacatgtgtaccctcatatctcgaggagatttgtcagtcactgcctcaactcggccgcggtcaccagtaggggaaaatgcagatgaacactattcaaaggaccatgatgtgaaaatggagattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggtaagtcattgcttcagttaatctataccctgattattttattataagatcaataactgttgaacgtcagattattcaa

SEQ ID NO: 17359 - DNA, 10744 bp, Homo sapiens
ccaactctcattcatttcgccggttaacatgagagatcatggccgccttcgggcttctcagctatgagcagagaccgctgaagcgcccccggctcgggccgcccgacgtctacccacaggaccccaagcagaaggaggatgaacttactgctgtgaatgtaaagcaaggcttcaataatcagccagccttcactggagatgaacatggctcagccagaaatattgtaattaacccatcaaagattggagcttattttagcagcatattagctgagaaactgaagcttaacactttccaggacacgggaaagaagaaaccacaagttaatgctaaagataattattggctggttactgctcgatcccagagtgcaattcatagttggttttctgacttagcaggaaataagccactttctattttggcaaaaaaggttcctatccttagtaaaaaagaggatgtttttgcatatttagctaaatattctgtgccaatggttcgagcaacgtggctgatcaagatgacttgtgcctattattctgctatatctgaagctaaaattaagaaacgtcaggctcctgatccgaatttggagtggacacagatatctaccagatatcttcgagagcagttggccaagatttctgacttttaccacatggcctccagcacgggcgatggccctgtccctgtgccaccagaggtggagcaagccatgaagcaatgggaatacaacgaaaagctagcatttcacatgttccaggaaggaatgttagaaaaacacgaatatttgacatggatcctggatgttttagaaaagatcagaccaatggatgatgatcttcttaaactcttgctaccactaatgctgcagtattcagatgagtttgttcagtcggcctacctgtctcgtcgtcttgcctacttttgtgcccggcgtctttccttgctgctgagcgatagccccaacctccttgctgcccactcaccccacatgatgataggaccaaacaactcgagtatcggggcccccagccctggcccccccggccctggcatgagccccgtgcagctggccttctcagattttctttcctgtgcacagcatggtcccctggtttatggacttagttgtatgttgcagactgtcactctctgttgcccaagtgccttggtgtggaattattccacaaatgaaaataagagcgcaaacccaggctcacccctggatctgctgcaggtggccccgtccagcctccccatgccgggtgggaacacggctttcaatcagcaggttcgggcaaggatttatgaagtagaacaacagataaaacaaagaggccgtgcagtggaagttcggtggtcatttgacaagtgccaagaatccacagcaggggtgactattagtcgggttttgcacacgttggaagttttggatcgtcactgttttgaccgaactgattccagcaattccatggagacactttatcataagattttctgggcaaaccaaaacaaagataaccaagaggttgcgcccaacgatgaagctgtggtgacgctgttatgtgaatgggccgtgagctgcaaacggtctggcaagcacagggccatggctgtggcaaaactcctggagaagaggcaagcagaaattgaggcagagagatgtggtgaatcagaagtcttagatgagaaggagtctatttcttcatcctctcttgctggatccagtttgcctgttttccagaatgtgctgttaaggtttttagatacacaggccccctctttgtcggacccaaacagtgaatgtgaaaaggtggaatttgtgaacctggtgctgctcttctgcgagttcatccgccatgatgtcttctcccatgacgcatacatgtgtaccctcatatctcgaggagatttgtcagtcactgcctcaactcggccgcggtcaccagtaggggaaaatgcagatgaacactattcaaaggaccatgatgtgaaaatggagattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggatgaatcttcaagtcatgaatgtaaccagcgcacaatccttctctatggagtcggcaaagagcgtgatgaagcaaggcatcagctgaagaagattaccaaagatatcctgaaaattctaaataagaagagcaccacagagacaggggttggggacgaaggacaaaaagccaggaagaacaaacaggagacatttccaacactggagactgtgttcactaaactccagctcctttcatattttgatcaacatcaagtgacatctcagatttctaacaatgtgctagaacaaatcacaagctttgcgtcaggaacatcctatcatctccctttggctcaccacattcagctcatctttgatctcatggagccagcactgaacatcaacggactaattgacttcgcaatacagttactaaatgaactgagtgttgtggaagctgaactgctcctaaaatcctccagcctggcaggaagttatacaacaggactgtgtgtctgcatcgtggctgttctcaggcgctatcacagttgtctaatcttgaatcctgatcagacagcccaggtgtttgaagggttgtgtggtgtggtcaagcatgtcgtaaacccctcagaatgttcttcccctgaaagatgcattttagcctacctctatgatctctatgtgtcatgtagccacctcagaagtaaatttggagacctcttcagtagtgcctgttcaaaagtaaagcaaaccatatataataacgtgatgcctgcaaattcgaacttgcgatgggatccagacttcatgatggattttattgagaatccctcagcccgcagcatcaactactcaatgctgggcaagatcctcagtgacaatgcggccaatcgctacagctttgtctgcaatacactcatgaatgtatgtatgggccatcaggatgctggcaggattaacgacatagccaatttctcctctgagcttacggcttgctgcactgttcttagttcagaatggctgggggttctgaaggctctttgttgttcttcaaatcacgtgtgggggtttaatgatgtactttgcactgtagatgtgagtgacctttcattccatgattcattagctactttcattgctattctgatagcacgacagtgtttttccctggaggacgtcgtgcagcatgtcgcacttccctctcttctagcagcagcttgtggggatgcggacgccgagcctggggcgagaatgacatgccgactcttgcttcatctcttccgagctccccaggcctgcttcttacctcaagcaacgggcaaacctttccctggaataagatcatcttgtgatagacacctcttagccgctgctcacaacagcattgaagtgggagccgtgtttgctgtcttaaaagcaattatgatgcttggagatgccaaaattggcaataacagtgtcagctctttaaagaatgatgacttcaccatgagaggtttgcgatgtgatgggaatgctgatgatatctggactgcctcacaaaatccaaaatcctgtgggaaaagcatttccatagaaactgccaatttaagagaatacgctagatatgtactgaggactatctgtcaacaggaatgggtaggagagcattgcttaaaagaacctgaaagattatgtacagacaaagaacttatattggaccctgtgctttcaaatatgcaagcacagaaattactgcagcttatctgttatcctcatggcattaaagaatgtaccgagggggacaatctgcaaagacagcacattaagcgtattcttcagaatcttgagcagtggacactgaggcaatcctggttagaactccagctaatgatcaaacagtgcttgaaggaccctggctctggttctgtggccgaaatgaacaacttactggacaatattgcaaaggcaacaatagaggtattccagcagtctgcagacctaaataattcttctaattctggcatgagcctcttcaacccaaacagtattggaagtgctgatacaagtagcacgagacagaatggaataaagacattcctaagttcctccgaacgcaggggtgtatggttggtggcccccctcatcgccaggttgccaacttctgtgcaaggaagagtgctgaaagccgctggggaagagctggagaagggacagcacttgggttcttcttccaaaaaggaaagggacagacagaaacagaaaagtatgtctcttttgagtcaacaacccttcctctcactggtacttacctgccttaagggacaagatgaacaaagggaaggcctcctaacatctctccagaatcaagttaaccagattttaagtaactggagagaagaacgataccaagatgacataaaagcgcggcagatgatgcacgaagcattgcaactccgcctaaatttggtaggaggaatgtttgacacggtgcagaggagcacccagtggactacagactgggccctgctactccttcagatcattacttcaggaactgttgacatgcacactaacaatgaattattcacaacagttcttgacatgctgggtgttttaatcaatggaacgttagcctctgacctatcaaatgcatcccctgggggatctgaagagaacaagcgtgcatacatgaatttagtaaagaaactgaaaaaagagctaggagacaagcgatcagaaagtattgacaaagttcgacagttactacctttgccgaaacagacatgtgatgtcatcacttgtgaacctatgggttccttgattgacacaaaaggaaacaaaattgctggatttgactctatagataaaaaacagggtctccaggtctctacgaagcagaaggtgtccccgtgggacttgtttgagggtcagaagaacccagctcctttgtcctgggcctggtttgggacagtccgagtggaccgaagagtgatcaagtacgaggagcagcatcacctcctgctgtatcacacacaccccatgcccaagccccgcagttactacctccagccactgcccctgcctcctgaggaggaagaggaagagcccacatctccagtttctcaggaaccagaaaggaagtccgctgagctgtcagatcagggaaaaaccacaacagatgaagaaaagaaaacaaaaggaaggaagcgcaagacgaaatctagctcaagagttgatgaatatccacagagcaacatataccgagtgcctcctaattactcgcctatctcctcccaaatgatgcaccatccacagtccaccttgtggggttacaacctcgtgggccagccccagcagcccggctttttccttcagaaccaatctcttactccaggtggctccagattggaccctgcaggctcctttgtcccaaccaacaccaaacaagctctgtcaaacatgctacagcggcgctcaggcgccatgatgcagccgccttctcttcatgcaatcacatcgcagcagcagttgatacagatgaagcttctgcagcagcagcagcaacagcgacttctcaggcaagcccagactcggcctttccaacagggccagccgggggaccaggctgctctctttgctgcgcaagcacggccctcccctcagctccctcagtatccagggctgcagcaagcacagaccatgccacagggctatacaatgtatgggacacagatgcctttgcagcagacatcgcagcagcaggctggcagtgtggtcctgtctcccagctataactccagagcctatccggccgcacattccaaccccgtgctaatggaaagactcagacagattcagcagcagccgagtggctatgttcagcagcaggcctcgccgtacctgcagcccctgactggctctcagagactgaaccatcaggctctacagcagagccctctggtgggcgggggaattgatgctgtgctgacttctgcacatccaaaccttccctccgtgcccctgcctcaggatcccatgagacccagacagccgcaagttcgacagcagcagagactcctccagatgcagcagccccagcagccccagccccagcagcctccccagccccagcagtcctcgcagtcccagagtcagacccttggtctccaagcaatgcagccccagcagcccttgtttcccaggcaaggcttgcagcagacccagcagcagcagcagacggccgccttggtgcggcagctccagaagcagctttccagcaaccagccacagcaaggagtgactccgtatgggcatccttcacacttctgaatctgcaagaggagaagacatgacgttttatgtttgcactgaaaaacagaaaatcaaatttaatgcattagtcatcttaaaaatgtccctttttttcatttctttgacattttactatattttatgctacatctcacaaaaaaaaaaaaaggtgtttaaacaaaaagccaaggagaagttgtggtttgattttgttgaattcacctttaaagtaggtttacaaatgtgaatcatgcaggcaggcctactcccggaagagtgtgctagcagaccttttgaaattggtgctttttttgaatctcacatttctagaaagaatggattatgatggatctaaggtatttatgtatttcattcattaatgatgacgttgtttttttttttttaattttattttccaaactgtgctggaccaaactactgatttgaaaggcatgtcagatcttgacagaaacatggcctgtttattctgcattcacctgtgatggtgaaacggacatttatttgcatcgctctaatttgaaatgtttgtaatctcataagcactttataaactttgttcttatttatgtaggactcttctttgcttttgttgtggtcaaaaggtgctgaaacagattgttgcttcgtacttaaacttcttaaaccaagaacctaaaccaaggtttctttgagagccgccctaagatgtgcggaaacctgttagaagtagctgtactcaaatttgttttgaggcaagatcattgatgagagtcattgtgaaggtacaacatgtaaatcctaaaggcctgaaagaactgcagtggaatcgtccaactatttattgccagttttggttctcctgaaccttatgccaccttaaggggaaaaaaaaatccagtagctggcttgagattccagtgctcacacttgacatggtttccagagaatctggccccaaagtccagaaggctctggttttcataaaaggtgtatttgctgtttattttgtatggtaagtatttgctcttttgaatttaattattactgtcagtgtcagtcttggttgtgtattgcatatactgtatttataaattggtgcaaaaagcacaagtaaattatacatcaaatttattataaagaaatagtaactattttaactttgttcaagtatgtggtaatttgctcctattagagtaaaaaagaaaccagtaaattatcagtttgtgtaacttaagagtattctatataatatttttttagatttagatgcataaaattttgaatgtgaaaattgcagggcattttaaaacatatgtgggggatattttcccatgttctctgttatttcattttcttttgccatatgattttacatataatatagtcaagcatactgtgaatagacttgtctataatgagcagaccatgtaaatctactttttttaaaatgtagctagtacaactttagtagacattttcttttgcaaatcattatctataaataatttatatcttcctgggtgagttactcattgcaaagtttgactcatgcaaatgacctcaaatacatgtcagcttactttgctgtggcaacatccatgtgaactgctttgtacactgtgaaaatatttcactccagcctgcccattttgtgtttactctgggctggaaaagactttgccaaaacattaaaaactattcttttcactaaattaatagtctatctgctttcagaagatgtatcatctatctgtacacatttttgctggttttgtatatcagattttttcctctcaagaaacatacttagataagctaatgaagttgttttcttcaaagtaatatatctatataatgactgcattggcaaatcaaccgaaatgtgaatgttgtgcctagtgagtgagtcatgttccatcattatttctttccaaatttctttgccagttcagtttgaaccatatattttgtagctcagcattgcaaacaacagtaatactgttttaagaatgagtgttataattgcatagcatttgtatgcactttatactttgcagaggtgagttaaattattaatcattttgcacatgaaagctgtggggcatatcttttttctttttttaggtgaggaagttatgctacgactctaattaattccacgattctattgaaagttgaggaatgctgttttacccctgcgcattataaagaaaataactagaattactttagtcttcagattttctccctgttaattctgtatcttgagaggtttcttttttttttttttttttttcttttcttgcaaatgcattcttttgcattaagatggtcacaaggtaaagccctgtggcagaacctggtactttaccttaccagaggaaattaccttagaataagatggagcgagaccccagctccccttaaagacaagaccttgaaatcaaatggagtcagctatacctatcaatcaatcacagttcttggatataagaagcccatagactctcttgtttacactgtaggctttttcttaatagggttgcatttgtcagtcattgcatttacccttcttggcctggaagtagaggagatcaatgcgtagctttgaccacttccagccacagggtactaacatcagacataagttgcaaccaggtcacattttaggctgagatggggctaactgaaagtcagtgtgatgaaaacccaagggcgctattccacatgtctcaaatgattggcaggggctaacttattagtaattctcggttttgtgcactgagatatctaagacctatggcatttttttcccatttataaagctcctataattcttaagtaagtactaggtgaatgtttgaatagatgctggagaaattacactggaaaaccccacccctagatttagataagatcaatcatttaatattccccaaattaattcaggttgaattaagcatgtaatataaattcagtgaattacaaaaacacattttgtgtaggattgatcagattttaaatacagtgaaacttcattatatataatagacctagaccctcccaagcattttcccatcccataaagaattaatgaaatgaaatgcttatagagcaacgattcctgctcagaaaaatttccttataaacagctccaaaccaggggtgcctgagctagattttaaagttataaagaagtttcattgtatttttaaaacctttttaatgggtgtatttggacaaaaataacccccttttcacattttatgatgtgcaggtattacattgctttttacatgtggaaaagtgagcctgcatttatttttaaatgcagttattaaaacatttttgtattccccatcaatgaaaattttcagtgtgaacaaatggtgaatcataagacagttcagtgcttattttctgtaggttttagcaaaaaaatttataaaccacaaaatatttatacatcaggatggtaaatttacatcataaagattgcagatttaatattttccattgtctctgttctgagtgccatgcttgtaacattgataggaggtggacactaggcaactggtattagaagttcatttttttactgaaaaattcaggtacattagccatttgttattttatagtgaaccgtttcaatgtttgtttattgttatttgttggcaaaataaaagtgccttaagttaaaagtttgttttgagatccattaaataaatcagtatcatcagttcataatgcatttatttacaagtccttttattttgcatgttcattgtaaatttaatactgtaaatgtattcaaattcatttacatgcctatggctgcctttgattaaacttcttccaaaaaataaattctgcccagatgttgttgactttattatttcatgtcagattacttgaatatacgttgctgcataatcactaccaagtgggttctttgctgtgcatttgtatatcccagaatcggaggtttggggattctgaatgactagggtaccttgtaagtgaagctgctcacttccatgtgtcctctctttacttgccgttgagagaagggagtggtcaggcatctcccatgtgatttctggcttgggaactcccaaggccacacagtggagctgaaaggctgcccctgtcctggtgacaatactcctgggtggacgatttgtaattcggggagggtaggctacaatcattactggaacagtaatcagtgtatgaccaacactattttgagccttacagatatagtttcctctgtcataagctgt

SEQ ID NO: 17360 - DNA, 7386 bp, Homo sapiens
gtttctctctctggtcggaggcggcggtaatggcggatggtgggttgtggcgccggcggcggctgctgtgagggacgatgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagacccagttttgctgaccttattcaccatgacttatcagaagaagaagatggagtgtgggagaatggactttcctatgaatgccgtactctgctttcaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtagaagatgggacatctagtgtaacagtgttatcacatgaagaagatgctatgtcattatttagtccctctatcaagcaagatgctccacgccctactagtcatgcccgtcctccatcaacaagtttgatttatgactcagacctggctgtctcttatactgaccttgataatctcttcaattctgatgaagatgaactaacacctggatctaaaaaatcagcaaatggatcagatgataaagccagctgcaaggaatcaaagacaggaaatctggacccgttatcttgcataagcactgcagatcttcataaaatgtatcctacaccaccatcattggaacaacatattatgggattttccccaatgaatatgaataataaagaatatggtagtatggatacaacacctggaggaactgttctagaaggaaatagttctagtataggagcgcagttcaaaattgaggttgatgagggattctgtagccccaaaccttctgaaattaaagatttttcttatgtctataagcctgaaaattgtcaaattctagtgggatgttccatgtttgcacctctaaaaactctaccaagccaatatctgccccctatcaaattgccagaagagtgtatttaccgtcagagttggactgttggaaaattggaattgctttcttcagggccttcaatgccattcatcaaagagggtgatggaagtaatatggatcaagaatatggcactgcttatacacctcaaactcatacttcttttgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactttgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacgatgtgagtatgcagtgctcacaggatatacttcgaatgctcctctctcttcagccagttcttcaggatgccattcagaaaaaaagaacagtaagaccttggggtgttcagggtcctctcacttggcaacaatttcataaaatggctggccgaggctcttatggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgagtcctgtcgattaggtcaacatagacctgtttctcgactgttaacagatgggatcatgagagttggatctactgcatcaaagaaactatcagaaaagttggtagcagaatggttttctcaggcagctgacggtaacaatgaagcattttctaaactcaagctttatgcacaagtctgcagatatgacctaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaagcacgatggatcgggataaagtgggaatccccacagatggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatgatggagcagatggaatgggtatctttgatttgttagacacaggagatgatcttgaccctgatatcattaatatccttcctgcttctccaactggttctcctgtacattctccaggatctcattacccccatggaggtgatgcgggcaagggtcagagtactgatcggctactatcaacagaacctcatgaggaagtacctaatattcttcagcaaccattggcccttggttactttgtatcaactgccaaagcaggtccattacctgactggttctggtcagcatgtcctcaagcacaatatcagtgtcccctttttcttaaggcctctttgcacctccacgtgccttcagtgcaatctgacgagctgcttcacagtaaacactcccacccacttgactcaaatcagacttcagatgtcctcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtacc

SEQ ID NO: 17361 - DNA, 10464 bp, Homo sapiens
gtttctctctctggtcggaggcggcggtaatggcggatggtgggttgtggcgccggcggcggctgctgtgagggacgatgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtagaagatgggacatctagtgtaacagtgttatcacatgaagaagatgctatgtcattatttagtccctctatcaagcaagatgctccacgccctactagtcatgcccgtcctccatcaacaagtttgatttatgactcagacctggctgtctcttatactgaccttgataatctcttcaattctgatgaagatgaactaacacctggatctaaaaaatcagcaaatggatcagatgataaagccagctgcaaggaatcaaagacaggaaatctggacccgttatcttgcataagcactgcagatcttcataaaatgtatcctacaccaccatcattggaacaacatattatgggattttccccaatgaatatgaataataaagaatatggtagtatggatacaacacctggaggaactgttctagaaggaaatagttctagtataggagcgcagttcaaaattgaggttgatgagggattctgtagccccaaaccttctgaaattaaagatttttcttatgtctataagcctgaaaattgtcaaattctagtgggatgttccatgtttgcacctctaaaaactctaccaagccaatatctgccccctatcaaattgccagaagagtgtatttaccgtcagagttggactgttggaaaattggaattgctttcttcagggccttcaatgccattcatcaaagagggtgatggaagtaatatggatcaagaatatggcactgcttatacacctcaaactcatacttcttttgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactttgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacgatgtgagtatgcagtgctcacaggatatacttcgaatgctcctctctcttcagccagttcttcaggatgccattcagaaaaaaagaacagtaagaccttggggtgttcagggtcctctcacttggcaacaatttcataaaatggctggccgaggctcttatggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgagtcctgtcgattaggtcaacatagacctgtttctcgactgttaacagatgggatcatgagagttggatctactgcatcaaagaaactatcagaaaagttggtagcagaatggttttctcaggcagctgacggtaacaatgaagcattttctaaactcaagctttatgcacaagtctgcagatatgacctaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaagcacgatggatcgggataaagtgggaatccccacagatggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatgatggagcagatggaatgggtatctttgatttgttagacacaggagatgatcttgaccctgatatcattaatatccttcctgcttctccaactggttctcctgtacattctccaggatctcattacccccatggaggtgatgcgggcaagggtcagagtactgatcggctactatcaacagaacctcatgaggaagtacctaatattcttcagcaaccattggcccttggttactttgtatcaactgccaaagcaggtccattacctgactggttctggtcagcatgtcctcaagcacaatatcagtgtcccctttttcttaaggcctctttgcacctccacgtgccttcagtgcaatctgacgagctgcttcacagtaaacactcccacccacttgactcaaatcagacttcagatgtcctcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtaccaggtcttacagcattttatatatcacatctttacagaataacatgatggcaatatacaagtggtattgttaggtggtttaacttagaataaaatgagaattcttcagttatattttgtactatggtttagggctatgactaatatttcaggccatttccggtgaaagaaacttagttttacaagaaaaaccatttgctactgaatgcttaaactaattttagtgtttaatgttacatgcttaaatttttttcagttttaacagtggcatatttaggcatggaaatattattatgaaatttattttcaggatctgctataaggttgaaatttagcccagctctaggcattttacaaattatttttcaagcagtcattcttgattgtttgacttttttttttaaattaaagattgggaatgtatgtgagagtatgcatatgtatgggtgtgtgtgtgtgcgcgcaatcaaactgtggtgtaaatagattctcagtgaattctggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaagaagggacttgaattttagggactttaattcacccctccttcaatacaactttcccccttcttgtttgcacatgccaagataactgcttttatgcaggctgtacccccttgaaaaatcctttctacagtgctgctcacaaaagagcccaagttcgcctcctacctgcattgctgacttgaattcacagtcgccgagtctacctagctttcttggaagcagtctagcaaaatttctatttgtacgttcactaattatctacaaggacaaaatcagttgtatttacaaaactctacttcagtgtttgttttagtttttttttttactgaaacttgtttttgtgaatactctgtgcttagaattaaatatcactttcttatgaacaacataacttcttcagattgtgtatatgaaaacattagcaagtcttgttttttctatgaagcaaacacaattggtgacaaaggttgtcaatcatttcttcaaaattataatgcagttctaatggtcagcatattttgatattaaatttaaagatcacctctctgcatttgtttttaaattatgctaatacaccacacattatgttggtatgttttgttctgtactttctttaaaaaaaaaaaaaaaacttgtctgagatttgaaggaaaatgtgcttatttggaatttccataaaaagagtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagaaaagctcagtagacttatttgagaaattaagccttgtgcaggatgatggatttgacttactaatgtactgtcacagacaaatatgggtagttttgtttaaataggtaagcaaaatattatactttatagcagtggattaccaacaccttgacttctttgttacagtgctaacatctttttttttgtgcaggtatccatgattattaagcagggtggaagttcagtattttgtcatttaaaaagattagttatataatgtctgcttccagccagtgagaaacatctagccatacctttcttatgcaagccattgagttatcaggactgtgaattaacactgtatgaataaatttctgtacaccttattgtttggccagaaggccaccaagtgtacttatatgtaatccttaaattttaaagtagctgtaatttttaaatatttctaaacttttcttaaaccactaaaattaagctcttactacttagtcaactatcctcagctgtattcgtactcaattgtcagtatggcacagattactgtattaaaatattctcctttcgtcttcatatttaccttctgaggtaattttttaacttaatgtgttactacaaagatttgcagatctttaatcaagcactatgttaatactgtaatatcagaatactatgttgcattatttaaaatgttcaaattgaatagattaaaaagtttttaaatgctattgcatcatataatttgctattcatccactatggcattgcatatcaatcagttaatacacttaatgttgcatgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaagttttaaaacatctttagttttcaaagtaaactggatatgtggaccttaaagttattgagtttaagctacaaattgtaacgtcattactggacatgtcagcatcaaccctctcaaaatagcttggtcactttatgaaggggcgttttaaagttgttgtttagcagtgacatttaatatggtccaattgcttttctttttaacgtgacaaaaagagaataaggaacaaacactattgctgccgaatgccataacactgagttgtacaaattgtgattgaggaaatgaaaaggtttatactttttaaaaaaaaaaaaacaaaaacaaaaaacaaaacttcaaatggaataaattattcatgaagccttc

SEQ ID NO: 17362 - DNA, 9530 bp, Homo sapiens
cccccccgccagcccgggcccgctgcccccggcgcggcgtcgccgcggcgcctcccgcctgcccgccggccctcgcgccctcccccggcggcggcggcggcccggccgccccgcgctccccggcgaggcgccgccgcccggcccggcctcgcctcggacgcctcgctccgacatgccccgctctggcggccgggctcgcggaggatcatgactgcggcagcgaactgggtggcgaacggggcgagcctggaggattgtcactccaacctcttttcgctggctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataagtcagaggatggatttggtaccaaggatgtcactacaccaggtcattccacgccggtgcctgatgggaaaaatgccatgtctattttcagttctgctactaaaacagatgtccggcaggataatgctgctggcagagctggctccagtagccttacacaggtaacagatttggcaccttccctgcatgacttagacaacatctttgataattctgatgacgacgaacttggggctgtatcacctgctctgcgctcatcaaaaatgcctgcagttgggacagaagaccgacctcttgggaaggatggaagagctgctgttccttatccaccaacagttgcagacttgcaaaggatgtttcccactccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaataacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatgtgctggacatcagcatgctctcctcccaggatgtggttcgtatgctgttgtccctgcagccctttctccaagatgccatccaaaagaagcgcacgggcaggacctgggagaacatccagcatgtgcagggaccactcacttggcagcagttccataaaatggcaggacggggaacctacggttcggaagaatctcctgagccgttgcccatccccactctgctggtaggctatgacaaggatttcctcaccatctcgccattctccttgccgttttgggagaggctcttgttggacccatatgggggccaccgtgatgttgcctatattgtggtgtgtccagaaaatgaggccttgctcgaaggagccaaaactttcttcagggacttgagtgctgtatacgagatgtgtaggcttgggcagcacaagcccatctgcaaagtgctacgtgacgggatcatgcgcgtgggaaaaactgtggcacagaagctgacagatgagcttgtgagtgagtggtttaaccagccttggagcggcgaggagaatgacaatcattccagactcaaactttatgcgcaagtttgccgccatcacctagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaagattggagtatcctccttggagaatgttcactacagacaatcagcaaaaagctcaaggatgtgtgccggatgtgtggaatctctgccgcagactctccttctatccttagtgcctgcctggttgccatggagccccaggggtcctttgtagtgatgccagatgctgtcacaatgggctctgtttttggccgaagtactgcactgaacatgcagtcatctcagctcaacacccctcaagatgcttcttgtacacacatcttggtgttcccaacatcatcaaccatccaggtggctccagccaactaccccaatgaagatgggtttagccccaacaatgatgatatgtttgttgaccttccattcccagatgatatggacaatgatattggcatattaatgactgggaacctccattcctctcccaactcttccccagtaccctccccaggctctccttctggaattggtgtgggctctcacttccagcatagtcggagccagggtgagcgtcttctttctagagaagcaccagaggagctaaagcagcagcccctggcccttgggtattttgtatcaactgccaaagctgagaatcttccccagtggttttggtcatcgtgtccccaggctcaaaaccagtgccctctcttcttaaaggcttcgctgcatcaccacatttcagtagcacagacagacgaacttctgcctgccaggaattctcagcgggttccacaccctcttgactccaaaaccacgtcggatgttttaaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatctgggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttactgaattaatctgaaatgtacaagccctggatttgctacagagtgagaagttattttatttttttttatttttaattttggaaattctgcagaaatcagaactcttaccatggtttgaacaaaaaaaggggaaatggggaggggaaaagggtgggattgtccagcatgcttgtatgtatatttcagaaccttttttaaatgtaaaagctgtacatttctgggaagttctgaatttcttttgtttccttttttccttcaagcattttgcagtgagcttcttttatatatagcaaacaatttgaaagaatacaaaaatatgtgaagttcatttaaaaaaataactacagtatagcgctggtacagtacactaaaagactttgataaaaagaaacaataataaaaggcctccattttaaatgtcattcatatataccttgtggatgagagctatatacttttacacacttttttagaggaataaattattgaattactgaa

SEQ ID NO: 17363 - DNA, 7984 bp, Homo sapiens
cggcccggcggtaggcggtggcgactctgcccgctcccgtttcggcgcggtgaccgagcgcccgggaggctcgaggaccgcatcgtgtgccgttgcgccaagcccggtcctgcgccgccatggccccagtgcagctggagaaccaccagctggtcccgcccggaggcggcggcgggggcagcggcggacccccgtcagccccagcccctcctcccccgggagccgccgtggcggcggccgctgcagctgcggctagcccgggctaccggctgagcaccctcattgaatttctgctgcaccgggcctactcggagcttatggtgttgacggacctactgccaaggaaatctgatgtggaaaggaaaatagaaatagtgcagtttgctagccggacacgccaactcttcgttcgattattagctttagtgaaatgggctaataatgctggcaaagtggaaaaatgtgcgatgatttcaagctttttagatcagcaagccatcctgtttgtggacactgctgatcgcctggcctcgttagctagagatgctctggtccatgcacgcctgcctagttttgccatcccatatgccattgatgtactaactactggatcttacccacggctgccaacctgcattagggacaaaattattcctccagacccaattaccaaaattgaaaaacaagccacactccatcagctgaatcagattcttagacatcggcttgtaaccacagatcttcctcctcagttagcaaatcttacagttgcaaatggccgggtgaagtttcgtgttgaaggagaatttgaagccaccttgactgtgatgggagatgaccctgatgttccatggcgtcttctcaagctagaaattctagttgaggataaggaaacaggagatgggcgagctttggttcatagcatgcaaatcagcttcatccatcaactggtgcagtctaggctctttgctgatgagaaacctcttcaggatatgtacaactgcctacattctttctgtttatcacttcagttagaagtgttacattcccaaactctaatgttaatccgagaacggtggggagaccttgtgcaggtggaaaggtatcatgctggaaagtgcctctccctttcagtttggaatcaacaggttcttgggagaaaaactggaacagcatctgttcacaaagttacaattaaaattgatgagaatgatgtctccaagcctttacagatttttcacgatcctcctttgccagcttctgattccaaattagtagaaagagccatgaagatcgaccacttatcaatagaaaaactcctgattgacagtgtccatgcaagagctcatcagaagctccaagaactgaaggccattcttagaggcttcaatgccaatgaaaactcttccatagagactgcactcccagctcttgttgttcccatcttggagccctgtggtaattcagagtgtctgcacatttttgtagatttacattctggaatgtttcaattgatgctttatggacttgaccaggccactctggatgacatggagaagtctgtgaatgatgatatgaaacgaatcataccctggattcagcaacttaagttttggcttggacaacagcgttgcaagcagtctataaaacatctgcctacgataagcagtgaaacattgcagctttccaattactcaactcatcctattggaaacctttctaagaataaactgttcattaaacttacccgccttccacaatactacattgttgtggagatgttggaggttcccaataaacccacacaactgtcgtacaagtactactttatgtctgtgaatgctgcagatcgtgaagacagccctgcaatggcattgctgctgcagcagttcaaggaaaacattcaggacttggtttttcgtacaaaaaccgggaaacagaccagaaccaatgccaagcgcaagttgtctgatgatccatgtccagtagaatccaagaaaacaaaacgagcaggagaaatgtgtgccttcaataaagttttagcccacttcgtcgctatgtgtgatacaaatatgccatttgtaggacttcggttggagttgtccaatctggagattccacatcaaggagtgcaagtggaaggtgatggcttcagccatgcaattcgcttattaaaaattcctccctgtaagggtataactgaggaaacccaaaaggctctggaccgctctcttcttgattgcactttccgattacaaggtagaaataaccgcacttgggtagcagagttagtgtttgcaaattgtccacttaatggcacttctactagggagcaaggaccatcccggcacgtttacctgacatatgaaaatctgttgtctgagcctgttggtggtagaaaggtggttgaaatgtttcttaatgactggaatagcattgcacgattatatgagtgtgtgttggaatttgcacgttctctaccagacatacctgctcatctaaatattttctcagaagttcgtgtttataattaccgaaaacttatcttgtgttatggaaccaccaagggaagctcaattagtatccaatggaattcgatccatcaaaaattccacatttctttgggaactgttggcccaaactcaggttgcagtaactgtcacaataccattctccatcagcttcaagaaatgttcaacaaaacaccaaatgtggttcagttattacaggtactgtttgatactcaggctccattaaatgccatcaacaaactccccactgtgccgatgttgggcttgacccagagaaccaatactgcctaccagtgcttctccattctgccacagtcgtccacccacatcagactggccttcaggaacatgtattgcattgatatatactgccggagtcgaggtgttgtggcaatacgggatggtgcctatagtctttttgataacagcaaactagttgaaggtttctatcctgcaccaggactaaagacgttcctgaatatgtttgttgacagcaatcaggatgctcgaagaaggtctgtaaatgaggacgataatcccccttctcctataggaggagatatgatggattctttaatatcgcagctccagccaccaccccagcaacagccatttccaaagcagccaggaacatcaggtgcttatcctcttacttcaccccctacatcttatcatagcacagtcaatcagtctccctcaatgatgcacacacagtctccaggaaatctgcatgctgccagctcccccagtggggctttgagagccccatcaccagcgtcatttgttccaactcctcccccatcctcgcatggaatctcaataggaccaggggccagttttgctagtccacatggaactcttgaccctagttccccatacactatggtgtcaccaagtggacgagcagggaactggccaggatctcctcaagtgtctggcccctcaccagcagcacgcatgcctggaatgtcaccagccaacccctcactacattctccggttccagatgcttctcattcccctcgagctggaacaagttctcaaacaatgccaacaaacatgcctccacctcgtaaactacctcagcgctcttgggcggcatccatacctaccatcctcactcacagtgccttgaacattttactgctgccctctccaactccaggccttgtgcccggcctggcaggtagttacctttgttctccacttgagagattccttggatcagtcatcatgagacgacatcttcaaagaattattcaacaagaaacgctgcagctgataaattctaatgaacccggagtgatcatgtttaagactgatgcactgaaatgcagagtagctcttagtcccaaaaccaaccaaacgcttcagctaaaagtgacacctgaaaatgcaggacagtggaaacctgatgaacttcaagttttggagaaattctttgaaacaagagttgcaggaccaccatttaaagctaatacgttaatagccttcaccaagctattaggagctcctacacacatcctcagggattgtgtgcacattatgaagctggagctgttccctgaccaagcaacacagctaaaatggaatgttcagttttgcctgacgatccctcccagcgcgccgccgattgcacctcctgggacgcctgctgtggtgctgaaatccaaaatgctattttttcttcaactaactcagaaaacatcggtccctccccaagaacctgttagtattatagttccaatcatttatgacatggcttcaggtacaacccagcaggcagacattcccagacagcagaactcttctgttgctgctcccatgatggtcagcaacattctgaagaggtttgcagagatgaatccaccacgacaaggtgaatgcacaatatttgcagctgttcgtgatttaatggctaatcttacactgccccctggtgggcgtccatagacactattgtttttaaaccaggaaggctgacagatgagacaacaaaaaaaatctgaattcagccttcagtttaaaaaaggaaaaggactttttttttaaactttaagagctaaatattctaaactggcaaaaattttcagggtgcacttctttcatcaaaatgatcatccatcttttgtataatgaacttgtatagtgtgtttaaatgggacacatttcaaaggaaataaatcagtgtccgtttgccagtaataaatttaatattctgttttatactataaagttatgaaaatgccaaacttgtttatttaattgttttcttatgttttgggtgtaatagtccttttttggtttttgttttgttttttaaggcaggtctgtcatttttgaatactgtaaaactgtgataaactttatattgaagctgtattttaatatgaccgctttgaatccttacatgaaatgttctgggagttgttataaacacaccccaaggaagcaatatttaataaaactaggtcaaaaacaaaacaaaacagtgacactcacttgtgtgtatataaactctagagacatcttaggccctcccttcatctttaacctggtggatggagccagttattaatttataataatacatgtctgaaatttgaccaaaaacatcttctttatgtcaaggttaatatattttcttcagacattcctaacttgactagtggttaacatttagcaccttggttgtctttcaatatataggatttgggtgaaaaataaggaacttagtctttgagaagggacagtatgtggttcgtattgatcaaggatcccaaataatgcaatcattctcatctgttgaggatgtgggaacttttctgtcaggaaaatttagtttacagaatacttctgcatacaacattaattaggaaacaaagaactttaatgctgtacctctgcatgaagtttctgtgagctttctttatcttgcttaacttatcctcctttccttccccaccaaaattgggattgttctaaacaatttcaatttaattcattgtcaacaaaacgatagaatgttttgcttggaagaaacctggtccattcccctcattgtgaagaatcccgaatcctgggcctgtccagggtcaaatggagtttttggtattaatacatctctgcagggtttctttttggagcactgtgctgtctttcctagtcagtcagggacttttttaagcttcaaagaacatggtctgatgcaaaggtcttctaccgacttcatggtatttaggaaaaatttttaagtgataataccatgccgagttacctggtcactgtaatactggttctccattaaaatgtagatgctttgtctaattccacttcaagatgatttaattgagcttctataactatcaactatcaaattctagtttcaagtatctcactgtacctatatcatatctgttctcaactttgtttgattctccactcattttcaatcagagttgaagccttctttgcctttcttctttgtcttatttctgccttcatctcccacttctcacccaactctgccactgttcaggagcagttgactaaacttttatccttcctttaacttaatctttttatccttctgtttttagttcttacagtggtaatcacatcagtttggcaatctaagatgtctttatcaagggtcagcccttttctatttggagctgaatcttttctttcatgtagaaatctacatgtatatacaagaaatgtatttttatctgcaggataatattgtttcaaataattttattaagagttaactttttaggtattttcccttttaatgtggttttgaaatgttaattgcatttttacacatgatgcattcagtggacactcttttttcctaattataactcatctctgaatgcattgtgccaatcaagagtaagataggattcagtgcgcaaaatttgcttttgatgcttattaagagtaaacccatgaatttgaatttttatattatgcttggtacttggaattgatatataccttattaaagcttgaaaacatttagcatttgaatagtaagtttcatcacaaatcatgtcttttgcctcttttgttacccaggttcgatcaaggggactggatgcccaagtgattttctctaataatcgggttgggacttaactttaaggtgttttcaatgtgattttagtatttacagtaataaataaaatttatacaaagtttcagagaactaccaactctctagttaattttgatgaagatgttttcattaatagtctggtttagtattaatttaaccttgaaataagaaattggtcctgatttgccaccttcatttttccatctgctgaaatgccatttcagaatgtataaaagtactttcagaattagaagaaaagtgagagcttcagcagaacgtgtcaagtcgctaataacaggagtcgaaccttatgtttgaaaattaactgagtgagttaagtgcaagcataaactaaaatttatatgactttgaatttaagaaccactaataactgtgttctaattaacacagtaatctgttcagccaaaggatactaacagccattctttggactgtggttaatttgataacttcaagaagttataactttgctaccctggattctgatgcaatttcaatataaaaagttgttcctttcatagtttttccccccaaaagaagtgcctattacattttaccttaatgtttatttatcatccaagtgttcttgatataaaatcagtatacagaaaattttaagagaacttacattcaagggacatagagggaaaatgttaatgtgtatttcattgtttcttgtggaatttttttttcattcggtttgagaatggacagtgtgtctaaggatgtgatttaaatttacttaggatggatttagcattgaggttattaagacaaagttagcagaggccagccagcactgtgctgcacaactccaggaactccatggtatgctcacaattttctgcaagttgcctccacttccaagtggccagtgatttgttaaaataccttgcccaagaatataactgattgatgaaagggcatatttaggtcaatataaaataatagcaagtatttactgagagcttactgtgtgctaggcattttcttaatatttcaatgtgtatttaatcctcacaacaacccaatgtggtaggttattgatatcctcttcttaaaaatgagtaaatggaggcccagagaaatgtaatttgcctgagatcaaattaaggttgcttaagatcaaactgctaagaaggggcagtttgagtctgagctagtgctcctaaacactggacatttttgctgtgaaccacagtcgggaaggtttaatgtttagactctttcctcagaggcttttaactacacacaattttgacatgttttccaagctcagaaagctcattaaaaacaactaaaactg

SEQ ID NO: 17364 - DNA, 557 bp, Homo sapiens
gttgcaggaccaccatttaaagctaatacgttaatagccttcaccaagctattaggagctcctacacacatcctcagggattgtgtgcacattatgaagctggagctgttccctgaccaagcaacacagctaaaatggaatgttcagttttgcctgacgatccctcccagcgcgccgccgattgcacctcctgggacgcctgctgtggtgctgaaatccaaaatgctattttttcttcaactaactcagaaaacatcggtccctccccaagaacctgttagtattatagttccaatcatttatgacatggcttcaggtacaacccagcaggcagacattcccagacagcagaactcttctgttgctgctcccatgatggtcagcaacattctgaagaggtttgcagagatgaatccaccacgacaaggttcgatcaaggggactggatgcccaagtgattttctctaataatcgggttgggacttaactttaaggtgttttcaatgtgattttagtatttacagtaataaataaaatttatacaaagtttcagagaa

SEQ ID NO: 17365 - DNA, 1480 bp, Homo sapiens
ccaagtggacgagcagggaactggccaggatctcctcaagtgtctggcccctcaccagcagcacgcatgcctggaatgtcaccagccaacccctcactacattctccggttccagatgcttctcattcccctcgagctggaacaagttctcaaacaatgccaacaaacatgcctccacctcgtaaactacctcagcgctcttgggcggcatccatacctaccatcctcactcacagtgccttgaacattttactgctgccctctccaactccaggccttgtgcccggcctggcaggtagttacctttgttctccacttgagagattccttggatcagtcatcatgagacgacatcttcaaagaattattcaacaagaaacgctgcagctgataaattctaatgaacccggagtgatcatgtttaagactgatgcactgaaatgcagagtagctcttagtcccaaaaccaaccaaacgcttcagctaaaagtgacacctgaaaatgcaggacagtggaaacctgatgaacttcaagttttggagaaattctttgaaacaagagttgcaggaccaccatttaaagctaatacgttaatagccttcaccaagctattaggagctcctacacacatcctcagggattgtgtgcacattatgaagctggagctgttccctgaccaagcaacacagctaaaatggaatgttcagttttgcctgacgatccctcccagcgcgccgccgattgcacctcctgggacgcctgctgtggtgctgaaatccaaaatgctattttttcttcaactaactcagaaaacatcggtccctccccaagaacctgttagtattatagttccaatcatttatgacatggcttcaggtacaacccagcaggcagacattcccagacagcagaactcttctgttgctgctcccatgatggtcagcaacattctgaagaggtttgcagagatgaatccaccacgacaaggtacatgaccagtagacaatattttattgcatatatgttataaaagttcttttgagagacacccctttctcctcttctcttctccctccttacctactctaccacccaatcatagcaatagaggtctggttgccgtggccctcttaatgtctgcctgtcgctttcttcctttctcactggttcttcatttttgtccatttctctgctgcctggactttttgttagtgatttactattgggactgacccagttgctaatgccagaagcttgtatttatagcacacattgccacaaagacctaggttaggatgatagaattttccacggctgtgaattcctgccctaccatcaatacctgccactctgtacatcacaaagttgaaatgcatgttggtttctcatatttcatggttcaatcacgaatagaagaatattattaaaagttctgtatcttctaaatgttttgtgaagaataaaagctgatacaaatgg

SEQ ID NO: 17366 - DNA, 3351 bp, Homo sapiens
ggctctgtgactgaggcggcggcggtggcggccaagcgggatacgggcggcgggagctggggaacaggcatggacgtttccgggcaagagaccgactggcggagcaccgccttccggcagaagctggtcagtcaaatcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccagatgatcacggaagccttggcccaaggtgggatgcacataagagcccggttcccgcctaccaccgctgtgtccgccatcccgtcaagctccatccctttgggcagacagcccatggcacaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgtt

SEQ ID NO: 17367 - DNA, 3252 bp, Homo sapiens
ttgggcctggctctgtgactgaggcggcggcggtggcggccaagcgggatacgggcggcgggagctggggaacaggcatggacgtttccgggcaagagaccgactggcggagcaccgccttccggcagaagctggtcagtcaaatcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgtttgtcagttgttca

SEQ ID NO: 17368 - DNA, 2235 bp, Homo sapiens
ccaagcgggatacgggcggcgggagctggggaacaggcatggacgtttccgggcaagagaccgactggcggagcaccgccttccggcagaagctggtcagtcaaatcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgcccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgta

SEQ ID NO: 17369 - DNA, 3210 bp, Homo sapiens
gactgaggcggcggcggtggcggccaagcgggatacgggcggcgggagctggggaacaggcatggacgtttccgggcaagagaccgactggcggagcaccgccttccggcagaagctgcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtg

SEQ ID NO: 17370 - DNA, 3041 bp, Homo sapiens
ggtttgggcctggctctgtgactgaggcggcggcggtggcggccaagcgggatacgggcggcgggagctggggaacaggcatggacgtttccgggcaagagaccgactggcggagcaccgccttccggcagaagctggtcagtcaaatcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgcccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgtttgtcagttgttc

SEQ ID NO: 17371 - DNA, 2703 bp, Homo sapiens
acactgaatagggaaagggagagaagcagccggctgtagtgggtttagcagggctgggtgcttcatggtttctcttccagaaaagcgcatcaacggtgaaagaaagtgatgggaggagggtggatgtaagatgagattgggaaggtagttgtttggggtgtgggcggtgggacggaggatctgagggtgaccccccgaaggaatgtggactttgccgaaggatggcaggaagccgctgtcaggaagcgatcgtcgtttctggaggagagcgtgaagagctggggtcagtggccccgctcagaggaactctagcccctcaccaccgactgcttgtttctgttagcagtttttttcatgcgcgtccgtgtgaagagaccaccaaacaggctttgtcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgcctt

SEQ ID NO: 17372 - DNA, 2752 bp, Homo sapiens
acatgcttgcctggtggtgaatgggacactttcaggcgagacctaggggagccccaggccagcaccaggacagagatctcgaggcctttccaactctgctggttcttcagaagtcaaaccaacagattggagtatgtgaaggaagctcgtgtattcttctgaactagcttagacaacagtacacagtttgaagggcagcagccttttctgcagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccagatgatcacggaagccttggcccaaggtgggatgcacataagagcccggttcccgcctaccaccgctgtgtccgccatcccgtcaagctccatccctttgggcagacagcccatggcacagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcaccc

SEQ ID NO: 17373 - DNA, 2149 bp, Homo sapiens
gggcctggctctgtgactgaggcggcggcggtggcggccaagcgggatacgggcggcgggagctggggaacaggcatggacgtttccgggcaagagaccgactggcggagcaccgccttccggcagaagctggtcagtcaaatcgaggatgccatgaggaaagctggtgtggcacacagtaaatccagcaaggatatggagagccatgttttcctgaaggccaagacccggcccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccagtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacgtatgtccagctgggctgggctttgcggagggcggccagccctgggccgcgtgtgccaggtgtggtcaccatgccgcctccccagggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtcca

SEQ ID NO: 17374 - DNA, 4874 bp, Homo sapiens
gcaccgtgattcaccggaagcgctctagggaaccctggagcttccgcgcctgcccagttttgctccgaaagacttaccgaggagggagcttgcggtgcgttctgggaaagttgctgggccagctcctttgtttccagtctgagcgttgcgttcggtttcccgagggtcttctgaggcaccgcggctgcgggcttctgagttcccggctctccgcagggaagcctcctcttcgtacctcgttttttggctcgtggggggtcctcccaccgctggccgacgcagccagcatgtccggggtgcgcgcagtgcggatcagcatcgaatcggcctgcgagaagcaggtccatgaggtgggcctggatggcaccgagacgtacctgcccccgctgtccatgtcgcagaatctggcgcgtctggcccagcggatagacttcagccagggttcgggctccgaggaggaggaggcggcggggaccgagggcgacgcgcaggagtggccgggcgccgggtccagcgcagaccaggacgacgaggaaggagtggtaaaatttcagccttccctttggccttgggactcagtgaggaacaatttgagaagtgccctgacagagatgtgtgttctctatgatgttctcagtattgttagggataaaaaatttatgactcttgatcctgtctctcaggatgcacttcctccaaaacagaatcctcagacgttgcaattgatatctaaaaagaagtcacttgctggagcagcacaaatcttattgaagggggcagaaagactgactaaatcagttaccgaaaaccaagaaaacaagctacaaagagacttcaattctgagcttttgcgattacggcaacactggaaacttcgaaaagttggagataaaattctcggagatctgagctacagaagtgcaggatctctctttcctcatcatggtacatttgaagtaataaagaatacagatctcgatctggataaaaagatacctgaagattactgtcctcttgatgtccaaattcctagtgatttagaggggtctgcatatatcaaggtttcaatacaaaaacaggctccagatataggtgacctcggcacagttaacctcttcaaacgacctttgcccaaatccaaaccaggttccccacattggcagacaaaattagaagcggcacagaatgttctcttatgtaaagaaatttttgcacagctctctcgggaagctgttcaaattaaatcacaagtccctcacattgtggtgaaaaaccagattatctctcagccctttccgagcttgcagttatctatttctttgtgccattcctcaaatgataagaaatcccaaaaatttgctactgagaagcaatgtccggaggaccacctttatgtcctagagcataatttgcatctactgattagagagtttcataaacagaccttgagttccatcatgatgcctcatccagcaagtgcaccttttggccacaagagaatgagactttcgggtcctcaagcttttgataaaaatgaaattaattcattacagtccagtgaagggcttctggaaaaaataattaaacaagcaaagcatatttttctaaggagtagagctgctgcaaccattgacagcttagcaagccgaattgaggatcctcagatacaggctcattggtcaaatatcaatgatgtttatgaatctagtgtgaaagttttaatcacatcacaaggctatgaacaaatatgcaagtccattcaactgcaattgaatattggagttgagcagattcgagttgtacatagagatggaagagtaattacactgtcttatcaggagcaggagctacaggattttcttctgtctcagatgtcacagcaccaggtacatgcagttcagcaactcgccaaggttatgggctggcaagtactgagcttcagtaatcatgtgggacttggacctatagagagcattggtaatgcatctgccatcacggtggcctccccaagtggtgactatgctatttcagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaaaaatctccaaatacctttttttccccccaaatactttctaaactttttttttttgagatggtatctcactctgtagcccagtctggagtgcagtggtgtgatcatggttcactgcagtcttgacctcccaggcttaggtgatccttctgtctcagccttccgagtagctgggaccacaggcatgcacaaccacgcctggctaatttttgtattttttataaagacagggtttttccatgttgcccaggctggtttcgaactcggctcaagtgatctacctgcctctgcctcccaaagtgctaggattacaggcgtgagccaccatgcccagcctactctaaattattgataacctcttcctccagttgtctcctttaagctttcctgggtctaacctacataggtaatttaagaacatcctcagaaaggacagctgaaggcaataggaggcagattatctctttagggcgtcctcaagtttttttggtctgttctcccacttgattgacctcaccagttgagacacctagtgtatggctcatgcccagccttccacctgggattctccagcctccacccagcagccctggattgctttctccaattaaggcctttccatcagctctctgctttttcaaagcgaaaaaactaatggattagtgggttatcttttccaaggaacaggtttgcacttcttggaaaaagtgcctaaagtgtgcccattaatatgaggatagatttaggctcataagccttttggtaacactgaaagtagtatcatataggcaagctctccttataagtaaggctttcaatttttaaaacagacatcctgctttaacaatttgtaagatgactgtgcagtaataaaagtcctttgtatttctccaccgtgttttcattaaagaaaaatggagcttgtgggccacgatagaacaactttgtgcttttttccccttctgatcaagatcttgcatctttctatccatggaaattaaaataattggtatgaatttgcagttatttaaaaatcttgagtgcttcaaaaattattgttgcctgcaaaatttgccttggtcaataggctaatctgcacaattccactcacataaggagtcttttatgtgattttgaaggctcaggctagaagagtgagtctgagacttttgctgaatgaccagtttttgtttatataaacttctcccattgcagattgatactttggtaaactaataaaaatgaattcctaaaatgaaattttgaaaagatacaaaataaaagccccatttatttgattataacttgattaaattgcatcaaatactagaatttatagacagagtctcactctgttccccaggctggagtgcagcagcactgttttggctcactgcaacctctgcctcctgggttcaaatgactctcatgcctcagcctcccgagtaactgggattacaggtgtgtgccaccacgaccgtctaatttttgtaattttgataagagggttttgccatcttggccaggctggtcttgaactcctggcctcaattgatccgcccacctcggcctcccaaagtgctaggattacaggcataagccacagtgcccagcccccccaaatataaacatttctgaatgctttattttttatttctctgcttgtcatgaatcagtaacaaatcatggaccaggaccacaccttgagtagaatggctgagaatacatgtgcagatactaccgtctgttcttttaaaccccatctgagtagagtgggataactgaagactttacgttcttcatgtcttactttccctgtttggtacgtcgctgtagtgagtagccagtaccgacctaaagaattgtagaaactaaagcaaatgtgtgggaaaatggtagcttagttgctgtggtagcaattcttatgccttgtatttatttacattttctagtttaatgttttaacctgaatttcctggagtttgaaggatgtgctatggaaacttgggagacagtttgaagaaaaccaattagcccctcaacaagtattaacaggttggcaaggagctgtgtttgaatcttggctctgctactggcttgctgtatgaacttggcaaggattctctgtgaacttgtttccttatatataaatgaagatagaggtgcctcctctactaacctcagtggtgattgagaagtttcagtaacgttggtaataaatgttaaattctaaagtactacataaatataaagcattaagcaagtgtgcttctaagagtcaagccaattagaaaaa

SEQ ID NO: 17375 - DNA, 2432 bp, Homo sapiens
agttttgctccgaaagacttaccgaggagggagcttgcggtgcgttctgggaaagttgctgggccagctcctttgtttccagtctgagcgttgcgttcggtttcccgagggtcttctgaggcaccgcggctgcgggcttctgagttcccggctctccgcagggaagcctcctcttcgtacctcgttttttggctcgtggggggtcctcccaccgctggccgacgcagccagcatgtccggggtgcgcgcagtgcggatcagcatcgaatcggcctgcgagaagcaggtccatgaggtgggcctggatggcaccgagacgtacctgcccccgctgtccatgtcgcaggagtggccgggcgccgggtccagcgcagaccaggacgacgaggaaggagtggtaaaatttcagccttccctttggccttgggactcagtgaggaacaatttgagaagtgccctgacagagatgtgtgttctctatgatgttctcagtattgttagggataaaaaatttatgactcttgatcctgtctctcaggatgcacttcctccaaaacagaatcctcagacgttgcaattgatatctaaaaagaagtcacttgctggagcagcacaaatcttattgaagggggcagaaagactgactaaatcagttaccgaaaaccaagaaaacaagctacaaagagacttcaattctgagcttttgcgattacggcaacactggaaacttcgaaaagttggagataaaattctcggagatctgagctacagaagtgcaggatctctctttcctcatcatggtacatttgaagtaataaagaatacagatctcgatctggataaaaagatacctgaagattactgtcctcttgatgtccaaattcctagtgatttagaggggtctgcatatatcaaggtttcaatacaaaaacaggctccagatataggtgacctcggcacagttaacctcttcaaacgacctttgcccaaatccaaaccaggttccccacattggcagacaaaattagaagcggcacagaatgttctcttatgtaaagaaatttttgcacagctctctcgggaagctgttcaaattaaatcacaagtccctcacattgtggtgaaaaaccagattatctctcagccctttccgagcttgcagttatctatttctttgtgccattcctcaaatgataagaaatcccaaaaatttgctactgagaagcaatgtccggaggaccacctttatgtcctagagcataatttgcatctactgattagagagtttcataaacagaccttgagttccatcatgatgcctcatccagcaagtgcaccttttggccacaagagaatgagactttcgggtcctcaagcttttgataaaaatgaaattaattcattacagtccagtgaagggcttctggaaaaaataattaaacaagcaaagcatatttttctaaggagtagagctgctgcaaccattgacagcttagcaagccgaattgaggatcctcagatacaggctcattggtcaaatatcaatgatgtttatgaatctagtgtgaaagttttaatcacatcacaaggctatgaacaaatatgcaagtccattcaactgcaattgaatattggagttgagcagattcgagttgtacatagagatggaagagtaattacactgtcttatcaggagcaggagctacaggattttcttctgtctcagatgtcacagcaccaggtacatgcagttcagcaactcgccaaggttatgggctggcaagtactgagcttcagtaatcatgtgggacttggacctatagagagcattggtaatgcatctgccatcacggtggcctccccaagtggtgactatgctatttcagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggttt

SEQ ID NO: 17376 - DNA, 2278 bp, Homo sapiens
agttttgctccgaaagacttaccgaggagggagcttgcggtgcgttctgggaaagttgctgggccagctcctttgtttccagtctgagcgttgcgttcggtttcccgagggtcttctgaggcaccgcggctgcgggcttctgagttcccggctctccgcagggaagcctcctcttcgtacctcgttttttggctcgtggggggtcctcccaccgctggccgacgcagccagcatgtccggggtgcgcgcagtgcggatcagcatcgaatcggcctgcgagaagcaggtccatgaggtgggcctggatggcaccgagacgtacctgcccccgctgtccatgtcgcagaatctggcgcgtctggcccagcggatagacttcagccagggttcgggctccgaggaggaggaggcggcggggaccgagggcgacgcgcaggagtggccgggcgccgggtccagcgcagaccaggacgacgaggaaggagtggtaaaatttcagccttccctttggccttgggactcagtgaggaacaatttgagaagtgccctgacagagatgtgtgttctctatgatgttctcagtattgttagggataaaaaatttatgactcttgatcctgtctctcaggatgcacttcctccaaaacaggtatttgtggactttaattgaataataaaattttatttattaaatcccaggacccttttttggctttgtgcctgttgttccattttcctttcttgcaaaattaagtccagatgaagatttaaagactaactggtctaaaacaaagccatacaactgcatttcctttatttttttattatatacctatgatccttggaagagttaagtttcattaagaatgtaatacctttaaggccaggcgtggtggctcacgcctgtaatcccagcactttgggaggccaaggcgggcagatcacgaggtcaggagatcgagaccatcctggctaatgctgtgaaaccttgtctctattaaaaataacaaaaataagccaggcgtggtggtgggcacctgtagtcccagctactcagaaggctgaggcaggagaattgcttgagcctgggaggcgggggttgcagtgagctgagatcgcgccactgcactccagcctgggcgacagagcgagattccatcccaaaaaaaaaaaaaaaaagaatgtaatactttaaaggttaccaaatcttaacaaattcttatagcctgggtccttggtctgtgatatattacacaaaaatgtgatgatataatggctttggaatcaggtagacctggattcgaatcctgcctctgccttcattaactgtgtgaccttaaattaagcaagttattttctcttaagtccctgtttttccatctaatccttccttccctttttttttaagggatggattagaaaagttaggcgaaattatggagcatattgagagctgggtagaattgctgctatttcataaacagtgtattcaatttttgaacatttgaagatgaaagagaagtagcaggaagatgagttggtgaatagtctgaaatcattgaggctacttgggtccttaaggaaaacaagtgtcaagaccataaccaaattagtcatggagaagaagtaatgactgttagaacccatttgtaaataaaattaattgaatagaattactcacatagtaatagtttcagaatctagaaacattgtgctgggggactaatagagttccctaaatctgcattcttcattttatagagagaaaactaaagcttaaagagatttgtaatatgttcaagttgctgtcaagccagtagttagggagccaagactagaactccagcacctaactcatagccccactgccttttctactattctgtgcttttcccagaagggagtctccaggaatttcttaatatctccaggaactcttttatttacgttccctaatacaatcaaaagattattttgatatgtttatgaagctttttatgtgatttttgactctcatacagccagaaaactgtattaaactggttagtaaaatacacaaattatggtgattgtggatatttatatatgcatatgtgatacatagatagtgacttctgatcagttttccaaaaaattaggattcagtgaagtacatttaatattaacaatggcagggcacggtggcttatgcctgtaattccaacactttggggaaccaaagcaggaagccaggagtttgagactttcccaggcaacatagcaagaccctgtctctacc

SEQ ID NO: 17377 - DNA, 1831 bp, Homo sapiens
gaagttggctggttgcaccgatctgggggcttcccgggctcgggtaaccggagtgctggtatctaatcgtcgctcaaaagctcctaggtgcgcgggtggatataattcccggcttctcgagaagacactacagcctcaaggaggtatatcccgtgccttacctgactgggggctctgagtccagttgtgttgtcttcaacttagacaccatggaggcacctccagtcaccatgatgcctgtcactgggggcaccattaacatgatggagtacctgttgcagggaagtgttttagatcacagtttggaaagcctcatccaccgccttcgtggtttgtgtgacaacatggaacctgagactttccttgaccatgagatggtattcctccttaagggccagcaagccagcccatttgttctcagggcccgacgctctatggacagggcaggggcaccctggcatctgcgctacctgggacagccagaaatgggagacaagaaccgccatgccctggtgcgaaactgcgtggacattgccacatctgagaacctcaccgacttcttgatggaaatgggcttccgcatggaccatgagtttgttgctaagggacatttgttccgtaagggcatcatgaagattatggtgtacaagattttccgcatcctggtgccagggaacacagacagcactgaggccttgtcactctcctatctcgtggaattaagtgtggtagcacccgctgggcaggacatggtctctgatgacatgaagaacttcgcagaacagctaaaacctctggttcacctagagaaaatagaccccaagaggctcatgtgactaagaggatctgtccacatttggggcctatccttacttgtttgaaaaaatatgtttgctttttttggtttttgttttgttttgtttttgagacagagtctcgctttgtttcccaggctggagtgcagtggcacgatctcggctcactgcaacctctgcctcctgggttcaagcaattctcccacctcagcctcctgagtagctgggattacaggcacatgccaccatgctcagctaatttttgtatttttagtagaaatggggattcaccatgttggtcaggctattctcgaactcctgacctcgtgatccacccaccttggcctcccaaagtgctgggattacaggcatgagccaccacgcctggccaaaaaaatatgttttaaatgtcccatttcaccattgccaggcaggcattcttccttcagggagaggatggtgagaattaattggttctttgcactgttctcctcatgtggcgatttcactttcatgacagcctttctatattaaaggctcaggatgtcacggagaatctatctaatcccactgtattaagaggggaaaccgggccaagcgcagtggctcacacctctaatcccagcactttgggaggctgaggtaggtggatcacccaaggtcaggagtttgagaccagcctggccaaatggtgaaaccccatctctacgaaaaatacaaaatttagccgggcatggtagcaggcgcttgtaatcccagctacttgggaggctgaggctggagaatcgcttgaacccaggaggtgaaggttgcagtgaccagagatgacgccattgcactccagcctgggtgagaagagcgaaactccgtctcaaaaaaaaataaaaatgaagaggggaaaccagaataaattatcttttggaaaggacaatttcttgtttggccatttgtgtataaggttggtaacattagaggctgtgagcttgtgttacatggtaataaagccaatgaagaga

SEQ ID NO: 17378 - DNA, 1106 bp, Homo sapiens
ccgatctgggggcttcccgggctcgggtaaccggagtgctggtatctaatcgtcgctcaaaagctcctaggtgcgcgggtggatataattcccggcttctcgagaagacactacagcctcaaggaggtatatcccgtgccttacctgactgggggctctgagtccagttgtgttgtcttcaacttagacaccatggaggcacctccagtcaccatgatgcctgtcactgggggcaccattaacatgatggagtacctgttgcagggaagtgttttagatcacagtttggaaagcctcatccaccgccttcgtggtttgtgtgacaacatggaacctgagactttccttgaccatgagatggtattcctccttaagggccagcaagccagcccatttgttctcagggcccgacgctctatggacagggcaggggcaccctggcatctgcgctacctgggacagccagaaatgggagacaagaaccgccatgccctggtgcgaaactgcgtggacattgccacatctgagaacctcaccgacttcttgatggaaatgggcttccgcatggaccatgagtttgttgctaagggacatttgttccgtaagggcatcatgaagattatggtgtacaagattttccgcatcctggtgccagggaacacagacagcactgaggccttgtcactctcctatctcgtggaattaagtgtggtagcacccgctgggcaggacatggtctctgatgacatgaagaacttcgcagaacagctaaaacctctggttcacctagagaaaatagaccccaagaggctcatgtgactaagaggatctgtccacatttggggcctatccttacttgtttgaaaaaatatgtttgctttttttggtttttgttttgttttgtttttgagacagagtctcgctttgtttcccagcctgggtgagaagagcgaaactccgtctcaaaaaaaaataaaaatgaagaggggaaaccagaataaattatcttttggaaaggacaatttcttgtttggccatttgtgtataaggttggtaacattagaggctgtgagcttgtgttacatggtaataaagccaatgaagag

SEQ ID NO: 17379 - DNA, 1515 bp, Homo sapiens
cagcgccggggcggagggtacgatggagaatttcacggcactgtttggggctcaggctgacccaccaccgcccccaaccgcactcggcttcggaccaggaaagcctccacccccgccaccgcctcctgcgggcgggggacccggcacggccccgcctcccaccgcggccacggctcctcctggcgcggacaagtcaggagctggctgtggccctttttacctcatgagggaactgccaggtagcacagagctgacaggcagcacgaatctgatcacacactacaacttggaacaagcctataataaattctgtgggaagaaggtgaaggagaagctaagtaacttcctgcctgacctgccagggatgattgatctgcctggttcccatgataacagcagcctccgctctctcattgagaagccccctattctcagtagctctttcaatcctatcacagggaccatgctggccggcttccgcctccacactggcccgttgccggagcagtgtcgtctgatgcatattcagcctcccaagaagaagaataagcacaagcacaaacagagccgtacccaggatcctgtccccccaggtaaacccagttaagttccgtatggagctctggactcctaaattcccctgaagaagaaaccaatgtactgtggtctcttgggacttgggacagggactctagcagcacctctgtatcctttctggccatttggacaaaagcagttgccccgacttgggattttcctgtagtcttcagtggttcataacagtagaggattttgagctttacaggtgataggtacctaatgtctcctacagaaacaccatctgattcagatcacaagaagaagaaaaagaaaaaagaagaggatcctgaacggaaaaggaagaagaaagagaagaagaaaaagaaggtagagtagaggcctattgccacaacccagtgagtttccccagatctcacccctgtcctaaataccctagagttctttgcctcaagttggacccaagattgaaaacccaaggcaggttgcaggtttctcctgtacagcctgatcaaagccaaggctagttcctagttgttcttaccctgcttctttctcccccagaatcgacatagtccagaccacccaggtatgggcagctcccaggccagcagcagcagcagcctacgctaataggaccactggactctttgccaggatggcttttcctgctgtactgaacctgctgataaaagctgccttccaggctcttggacactgccttgggagcatcctgcagctgggacagaggccagctcctgttgggctcagttgagactaagtaaattaggagagagagggacatgcttttgtaggctcatcccagttggttttctcatggacatctcttcctctcccaggaagcttacaattttcttctctctcttttgtgcaatttgtctgatttaggacttgttctgtgttttctttaaaaaaaaaaaaattacatttatcaaa

SEQ ID NO: 17380 - DNA, 1089 bp, Homo sapiens
cacggagacagcgccggggcggagggtacgatggagaatttcacggcactgtttggggctcaggctgacccaccaccgcccccaaccgcactcggcttcggaccaggaaagcctccacccccgccaccgcctcctgcgggcgggggacccggcacggccccgcctcccaccgcggccacggctcctcctggcgcggacaagtcaggagctggctgtggccctttttacctcatgagggaactgccaggtagcacagagctgacaggcagcacgaatctgatcacacactacaacttggaacaagcctataataaattctgtgggaagaaggtgaaggagaagctaagtaacttcctgcctgacctgccagggatgattgatctgcctggttcccatgataacagcagcctccgctctctcattgagaagccccctattctcagtagctctttcaatcctatcacagggaccatgctggccggcttccgcctccacactggcccgttgccggagcagtgtcgtctgatgcatattcagcctcccaagaagaagaataagcacaagcacaaacagagccgtacccaggatcctgtccccccagaaacaccatctgattcagatcacaagaagaagaaaaagaaaaaagaagaggatcctgaacggaaaaggaagaagaaagagaagaagaaaaagaagaatcgacatagtccagaccacccaggtatgggcagctcccaggccagcagcagcagcagcctacgctaataggaccactggactctttgccaggatggcttttcctgctgtactgaacctgctgataaaagctgccttccaggctcttggacactgccttgggagcatcctgcagctgggacagaggccagctcctgttgggctcagttgagactaagtaaattaggagagagagggacatgcttttgtaggctcatcccagttggttttctcatggacatctcttcctctcccaggaagcttacaattttcttctctctcttttgtgcaatttgtctgatttaggacttgttctgtgttttctttaaaaaaaaaaaaattacatttatcaaa

SEQ ID NO: 17381 - DNA, 2438 bp, Homo sapiens
ggaactgaaggagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggcccagtgcccggggcatctctgtggaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtgctgactttcaggtccctggaccccagaaacccagggtagacatggactctactctccttctctggttctcagctgtggcttttgttctggggctgagtcccctccccaaccccctgactctcacacatagccccccatcagctgttttactccgtgccttactggatttggcctgtcctcaagaatggtaattatgaagagtggagaagtttggaccttgcctcctttaggggaaaggtaggacaggaatgtccctgcctggtactggtgggggaaatagtccgtatccccaactattaaggatttgtcccaggccaatggtgaacatgctgcattttatgtttggattgtgctgtaataagagcctcttccttccctcagaggatgtggctgggcttctatcctagagatggagtagaaggcacaactggtttgatagttactattttctgacctgtttgctgaagtgatttgcgaattgactttcctagggtgttgcctgagtcctttgaaatctccttctgacatctttcccttctgttgtgaaatatgttaagccacaggccaaactgctataagatcgaagtttgtttttttctcacctaataatagagaggtaatcagatggtctagggcagatttaactctacaaggttatcaggaactttgtttccttctgtcttattcagccattcccagtatgttttcttacccataagatcaaagcagactcatcagctccatatctgcattccactggggaaagagagagagaaaagagcagattttaaaaaaaagatatgactgagcattgctcagatcactgtggccacactttgctgaaagagatgctgggacatagaacctcttatctgggcagtcatgtgctgagttaaaactcagggattctgtgactacaagatgaaagacaatttggttgctgagatgcagttaatggcttctgttacatggagctcaatggacgtgcccaggaatgcttttggctgttattttgcagttaatacctcctgtaactaaagcatttgtttatgagttgacttgagagaagggctgatctcagagccgctttgagctaagttggattagtcacactaggaagttaattccacacctttcgtctaagtctcagtattgaggcctctccagttctcatgcaccctgatcttagggttagaatacttgaccctgatacctgcaccatgcttcatggttcctgagctctttctcctgtttcatttgagcctccaaactacatatttggtcatattgcctgcctaccccatgcctgctgcagaaatattcatccaggttaaccttgatatacacagagatggtcttggagaattgtgaatgtatgtactgtattgtcatcaaggatactgtcccttatttgaaggcatctaaagagaaactgttttcagatccaagtgctcagatctaaagcctctgcaacaagtcaggtggtggtcatgtttcccttctagttttggctgacaggaagctcagttcagtaccataactacagaacctgtcatctgtattttttgttctcaccccgtttttgttattttgtttctggttttttatattgaggtatgttttagatatagtttacaaaaataaaacgcacagatctta

SEQ ID NO: 17382 - DNA, 531 bp, Homo sapiens
ctggtgcgagaatcctgagaactgtgctccagttcttagaggggctctcagggactgtggtcctctattccttgtctttacaatgggggactggtccaagttgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggcccagtgcccggggcatctctgtggaggtggagtatggcccctgtgtg

SEQ ID NO: 17383 - DNA, 815 bp, Homo sapiens
gaaggagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggcccagtgcccggggcatctctgtggaggtaagaccttggtgaaaataggagcaggatgttctgagggggctgcttagcaaagggctctgaagattttccagttcttctctttttttttttttgagacagagtcttgttctgtcacccaggctggaatgcaatggcacaatcttggcacactgtagcctcgacctccagggctcaagtgatccttccgcctcagtctcccaagtacctgggactacacccaccgaattaaatttttttttttttttagtagaaatgaggtcttactatgttgcccaggctgatctcagactcctgggctcaattgatcctcccat

SEQ ID NO: 17384 - DNA, 932 bp, Homo sapiens
gagacagaaggttgtgttggggaactgaaggagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtgctgactttcaggtccctggaccccagaaacccagggtagacatggactctactctccttctctggttctcagctgtggcttttgttctggggctgagtcccctccccaaccccctgactctcacacatagccccccatcagctgttttactccgtgccttactggatttggcctgtcctcaagaatggtaattatgaagagtggagaag

SEQ ID NO: 17385 - DNA, 1753 bp, Homo sapiens
gttttggcgtctgtttgctgcggtaggaacatggcggatcggctcacgcagcttcaggacgctgtgaattcgcttgcagatcagttttgtaatgccattggagtattgcagcaatgtggtcctcctgcctctttcaataatattcagacagcaattaacaaagaccagccagctaaccctacagaagagtatgcccagctttttgcagcactgattgcacgaacagcaaaagacattgatgttttgatagattccttacccagtgaagaatctacagctgctttacaggctgctagcttgtataagctagaagaagaaaaccatgaagctgctacatgtctggaggatgttgtttatcgaggagacatgcttctggagaagatacaaagcgcacttgctgatattgcacagtcacagctgaagacaagaagtggtacccatagccagtctcttccagactcatagcatcagtggataccatgtggctgagaaaagaactgtttgagtgccattaagaattctgcatcagacttagatacaagccttaccaacaattacagaaacattaaacactatgacacattacctttttagctatttttaatagtcttctattttcactcttgataagcttataaaatcatgattgaatcagctttaaagcatcataccatcattttttaactgagtgaaattattaaggcatgtaatacattaatgaacataatataaggaaacatatgtaaaattctgttatgacataatttatgtctccattttgttgtattggccagtacttttacaaatcaaaacatctctcaagccaaaggagaagacagtaagaacagacataagggacattttagtttgggctagtgtcctgcctcttagaggtggcattgtgtaaatctgagctttgagcaagaaagttttggaaattgtgttgcttttaagaaatagagttagtgtggctggataagaaagtcacatttatgcaaatgtttcttctgctagaacctcatacctgttctagttcatctccacgtttattttaccaagagatcctctgtcaagagaatttcctggctgttgtgaaagaatttttctacatcctgaactatttttcctatttcttttcaccttgctttttttcatccttaatttgcttgtcatcacaatgaagtatgttttttgaatcatcaattctttctcattctccatttatctgaaggttcttttgcccttattaacctctcaacttttattgctgtattctagtcagaccagaacatacttccactacatcagttacttggcatcatttcacctcagtttattattgccaaataataatttgtgtcagcattttcaactatggttattcatccaacccttggatctctttgagtctactgataatctccactggaaaggtggaattgaaatgtggtccacattttaactagctatttcctggggctgtatttttcagaatatgctgagctacatttgctgcaatctgttgctattcagagtttaagtttcaggagaaaacaggaacaatagaacactctgcctgttatttttgttgtaatcaagcttttccacagttcttgaaaagtactatgtttcaaatttcaggaacaccagcgttagctgtaaaagttgcagcaatttattggctagtcatagaaaatttttgaacttttaactgtattttaattgatgtttattaaaaacactttgctatcag

SEQ ID NO: 17386 - DNA, 4581 bp, Homo sapiens
gagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagaccttgaacattgctcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcagtaaaaagtcagagtacacagcaagggttccaaattaagaggaagcaaaacgctgcccagatcctgagaaacctggagaaaatcaaccttagtagtttcaactcatacattgtcttgtttgattttgttctttgttttttatcctctttaagcacagatgcgtgttgaagtctaaggtgttctgtcatcacactctctttactagaataagtgtgcccaggcagaaaaaaaagtgtattcaatgttgctggcatgtgtggattcacagctcgtggctgtaaggaaatctgggggtttcataaatccattaaaatccttttagagttgccaa

SEQ ID NO: 17387 - DNA, 2811 bp, Homo sapiens
acgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagaccttgaacattgctcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggtaagaataaatacatttctaagcttattctcttag

SEQ ID NO: 17388 - DNA, 4576 bp, Homo sapiens
cgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagaccttgaacattgctcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtaaagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtgaagccagactgtactgtggagaaagtagaaatatatccgtctttgagagtggactcaaaccttttaaatctgaatgcgatcacactgtagtgatatagtagaagcagtgatgatattcagattgttttattttgattcaaatgatgaatctgttgacaccttataactcccatctccctatctatatttttgtctctaagagatcaagtaagatacatgttgttcatattcataacaacttattagagctatgtaggaacatagaggtatctgtgatcaaatgacttgtcattggcactttcagtctttcctattctagccgttgtttttgtttgtattttttattattaatgacatatttagtcttcagatatattattttaaaggcaccacacatgtaaaacagttattacaaatattttatacataaatctc

SEQ ID NO: 17389 - DNA, 4446 bp, Homo sapiens
gttcctgctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggttgacactctcacctgacagatgatgtaattcttcaatttttataatcttaaaatttttaaattttatatttgtaaatacagtacacattttatttcttggattttgagagacattgttaattttgggggaattggcattgcgaaagacttgaaaactaatgagtaaagtctgctgaatgaataaacc

SEQ ID NO: 17390 - DNA, 5233 bp, Homo sapiens
gttcctgctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtgaagccagactgtactgtggagaaagtagaaatatatccgtctttgagagtggactcaaaccttttaaatctgaatgcgatcacactgtagtgatatagtagaagcagtgatgatattcagattgttttattttgattcaaatgatgaatctgttgacaccttataactcccatctccctatctatatttttgtctctaagagatcaagtaagatacatgttgttcatattcataacaacttattagagctatgtaggaacatagaggtatctgtgatcaaatgacttgtcattggcactttcagtctttcctattctagccgttgtttttgtttgtattttttattattaatgacatatttagtcttcagatatattattttaaaggcaccacacatgtaaaacagttattacaaatattttatacataaatctcttggtagattttcagaataatagagatttatatcaagaaaaggaatctagattttgttgcattgtaggagcaaacaaggcttcatattctttttaaaatgacttgaaattttattataaatttccatagtttctatcaaggtcaactggcagttttattacctttgctatggacttgaacttactgtataaaattagttggaagccatgtaagaaaataacatctgaaaattcttgaacttaaaatcatgcttaaatggttgattctccaatttctttttttaaaaataagttaattgcttttgcaggttgacactctcacctgacagatgatgtaattcttcaatttttataatcttaaaatttttaaattttatatttgtaaatacagtacacattttatttcttggattttgagagacattgttaattttgggggaattggcattgcgaaagacttgaaaactaatgagtaaagtctgctgaatgaataaaccgtgtgattgtttcccg

SEQ ID NO: 17391 - DNA, 5245 bp, Homo sapiens
gctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagttaatctctgccctacagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtgaagccagactgtactgtggagaaagtagaaatatatccgtctttgagagtggactcaaaccttttaaatctgaatgcgatcacactgtagtgatatagtagaagcagtgatgatattcagattgttttattttgattcaaatgatgaatctgttgacaccttataactcccatctccctatctatatttttgtctctaagagatcaagtaagatacatgttgttcatattcataacaacttattagagctatgtaggaacatagaggtatctgtgatcaaatgacttgtcattggcactttcagtctttcctattctagccgttgtttttgtttgtattttttattattaatgacatatttagtcttcagatatattattttaaaggcaccacacatgtaaaacagttattacaaatattttatacataaatctcttggtagattttcagaataatagagatttatatcaagaaaaggaatctagattttgttgcattgtaggagcaaacaaggcttcatattctttttaaaatgacttgaaattttattataaatttccatagtttctatcaaggtcaactggcagttttattacctttgctatggacttgaacttactgtataaaattagttggaagccatgtaagaaaataacatctgaaaattcttgaacttaaaatcatgcttaaatggttgattctccaatttctttttttaaaaataagttaattgcttttgcaggttgacactctcacctgacagatgatgtaattcttcaatttttataatcttaaaatttttaaattttatatttgtaaatacagtacacattttatttcttggattttgagagacattgttaattttgggggaattggcattgcgaaagacttgaaaactaatgagtaaagtctgctgaatgaataaaccgtgtgattgtttcccg

SEQ ID NO: 17392 - DNA, 1206 bp, Homo sapiens
gagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaag

SEQ ID NO: 17393 - DNA, 641 bp, Homo sapiens
tgatagtacagatggagacgcaactgcagagcattttcgaagaggtggtgaaaacggaagttatagaagaggcttttcctggcatgtttatggatactcctgaagatgagaaaacaaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatc

SEQ ID NO: 17394 - DNA, 1636 bp, Homo sapiens
tgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatc

SEQ ID NO: 17395 - DNA, 2430 bp, Homo sapiens
acgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagaccttgaacattgctcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacagacattgttaattttgggggaattggcattgcgaaagacttga

SEQ ID NO: 17396 - DNA, 2835 bp, Homo sapiens
gctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcaggtactaaaaatttttaaacacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggtaagaataaatacatttctaagcttattctcttag

SEQ ID NO: 17397 - DNA, 3290 bp, Homo sapiens
tatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagtatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtgaagccagactgtactgtggagaaagtagaaatatatccgtctttgagagtggactcaaaccttttaaatctgaatgcgatcacactgtagtgatatagtagaagcagtgatgatattcagattgttttattttgattcaaatgatgaatctgttgacaccttataactcccatctccctatctatatttttgtctctaagagatcaagtaagatacatgttgttcatattcataacaacttattagagctatgta

SEQ ID NO: 17398 - DNA, 3506 bp, Homo sapiens
aagtgccaaaatggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggctccctttgtga

SEQ ID NO: 17399 - DNA, 3896 bp, Homo sapiens
ggtgcgatctcggctcaccccaacaacctccgcctcccgggttcaagcgattctactgcctcagcctcccgagtagctgggattacaggcatgcaccaccaagcccggctaattttgtatttttagtggagacgaggtttctccatgttggtcaggctagtctcgaactcctgacctccggtgattcgcccgcctctgcctcccgaagtgctgggattacaggtgcgagccactgcgctcggccgatactttcttagtgccccagtttaaggaagggcggttcaggaggagagagtctgacaggatcttactttatccctttagctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggctccctttgtga

SEQ ID NO: 17400 - DNA, 3456 bp, Homo sapiens
aagtgccaaaatggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggc

SEQ ID NO: 17401 - DNA, 3479 bp, Homo sapiens
aagtgccaaaatggcgatgcctaccacctagaactggattgtgcgctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggctccctt

SEQ ID NO: 17402 - DNA, 888 bp, Homo sapiens
caacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccaggtcttctctgggctctccatgtaccagttacctccgatgggtgaaggtcgggttggggcatccccggggagcaccacttttgcactcggcaggctgtttcccagcgctccatctgctccgtcccacagcagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtggggg

SEQ ID NO: 17403 - DNA, 994 bp, Homo sapiens
ggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcattgcacacatcccagggacttgggcagggtggcacccgagccaatcaaccaacagcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgt

SEQ ID NO: 17404 - DNA, 3334 bp, Homo sapiens
aagtgccaaaatggcgatgcctaccacctagaactggattgtgcgctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttg

SEQ ID NO: 17405 - DNA, 1986 bp, Homo sapiens
aagtgccaaaatggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcatggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggc

SEQ ID NO: 17406 - DNA, 2961 bp, Homo sapiens
gacaagtgccaaaatggcgatgcctaccacctagaactggattgtgcgatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggctccctt

SEQ ID NO: 17407 - DNA, 2256 bp, Homo sapiens
aagtgccaaaatggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggc

SEQ ID NO: 17408 - DNA, 3321 bp, Homo sapiens
aagtgccaaaatggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcatgtgccttcagcgcctggagaaaaccctcagcagcaccaagaaccgggccctgctgcacatcgccaaactagaggaggcctcattgcacacatcccagggacttgggcagggtggcacccgagccaatcaaccaacagcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggc

SEQ ID NO: 17409 - DNA, 1047 bp, Homo sapiens
aagtgccaaaatggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccacttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggc

SEQ ID NO: 17410 - DNA, 1524 bp, Homo sapiens
aagtgccaaaatggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggc

SEQ ID NO: 17411 - DNA, 2341 bp, Homo sapiens
atttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccaggtcagatgctgctgagcgggggtccccggggcccggtcccccagccgggcctgcagcccagcgtcatggaggacgacatcctcatggatctcatctgaatccccaacacccaataaagttcctttttaacac

SEQ ID NO: 17412 - DNA, 2331 bp, Homo sapiens
atttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccaccacctgcccagtcctggcccgcacaacttccccctcgggctccactgccaggtaaggggacccgggggagggcagaggtctggactgagtgtcccagcagctcctgggctagagcaccaagaccgagtgctcctgggaagtaaagacataggatccaagaatgagggttcccccatccgggcctgcagcccagcgtcatggaggacgacatcctcatggatctcatctgaatccccaacacccaataaagttcctttttaa

SEQ ID NO: 17413 - DNA, 2409 bp, Homo sapiens
atttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccagcggcaaaacgaaagagagaaggagagggccgtgtgtttcgagaaaaatgggagcgagcctatttctttgtggaagtgaagagcatgcctatgtgtttaatatgcaaacaaatcgtgtctgtgttgaaagaatacaacctgaaacgccactatgaatcaaagcatagtaagagctacgaccagtacacagaacagactcga

SEQ ID NO: 17414 - DNA, 1467 bp, Homo sapiens
atggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgcccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccaggtcagatgctgctgagcgggggtccccggggcccggtcccccagccgggcctgcagcccagcgtcatggaggacgacatcctcatggatctcatctgaatccccaacacccaataa

SEQ ID NO: 17415 - DNA, 2448 bp, Homo sapiens
atttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgatggggccagaaggtcagatgctgctgagcgggggtccccggggcccggtcgttcgccacagtccccaccactccctcttggcttccctgtgaggcagagagtcactgccttccatgtctctatcacaagcggcaaaacgaaagagagaaggagagggccgtgtgtttcgagaaaaatgggagcgagcctatttctttgtggaagtgaagagcatgcctatgtgtttaatatgcaaacaaatcgtgtctgtgttgaaagaatacaacctgaaacgccactatga

SEQ ID NO: 17416 - DNA, 2710 bp, Homo sapiens
attccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccaggtaaggggacccgggggagggcagaggtctggactgagtgtcccagcagctcctgggctagagcaccaagaccgagtgctcctgggaagtaaagacataggatccaagaatgagggttcccccatggcctttgcggagctctgagggctccgggaaagtacagcccatgggtccaaggacctagtgggttaagagcgtttcccatgatcctcctgtgtgtgctcctgggattgctgggaaatgtggtcttagggccagagaagtagttttggagaagggcccccaaaggctcatgggaaacagcatatttgtaactagatggggccagaaggtgcttctgttgggtcccccaagggctgcctagaaaacttagtgcctctgggccctcctgggcccaagggcctactgggagatgcagtcccttccccactgcccctcaggtcagatgctgctgagcgggggtccccggggcccggtcccccagccgggcctgcagcccagcgtcatggaggacgacatcctcatggatctcatctgaatccccaacacccaataaagttcctttttaacacac

SEQ ID NO: 17417 - DNA, 3332 bp, Homo sapiens
ggtggcatcgctccagggtcttcctccatcccgcagctgtcttccctctgtgtgtgtctccacatggcattctctctgtatctttgtgtctgtgcttataaggacatcagtaattttggattaggccccattttcctgacctcatcttactacaattgcaaagaccctctttccagatagagtcaccttcacaggtgctggggactggaacctcagcttagctttctggttttgttttttgagacagagtttcactgttgtcagccaggctggagtgcagtggtgcaatcttggctcacagcaacttccgtctcctgggttcaagcgattctcctgcctcagcctcccaagtagctgggattacaggcatgtgccactatgcccagctaatttctgtattttttagtagagacagggtttcaccatgttggccaggttggtctcgaacttctgacctcaagtgatctgcctgcctcggcctcccaaagtgctaggattaccggtgtgagccaccgcgcccagcctcagcatagctttctgggagtcacagttcacactttgtaactcggggaaggagcagatcagttacttccgtgcaccaggcactcctgcaggaaagagaaccttagggggatcacctcacgagaccctcacagaaccttgtgaagaaggcattcctgagagttagtacttccggctgcaaatcacgtagtttcccaaacacatagataattgggggcactcggaaaaaatgttctcttatgattctgtgggtcacctgggctcagtgggccatctcgcttggcgactctcacggggttgccatcagatggcagctgagactctggtcatctgaaacctttactgggctggatgttcaaaacagctcctcacacagccctggctgttggctggggcttggctaggaccggccatcccagtgtctgcacatggcctgtccacgtggccacactgtggcagctgggttctgagagggcaggcgttgtaggagcaggcatttatattttgcacaggacaggacatctagagggggccagctattgggattggtttcataggtctgtgacatcagggacagggccctgtggttctcttggcctctcctttatagtcacaaggtagctctcatggctccacgcatcctgtgtgctttcatgaaggaggggaagggggctgtgtgtttccctttcttcaagacagcagaaactttctcagattccagagcaggcattcctttcacctcctatcccggacctaggccactgggcagcccctagttgatgggaggctgctgggagcaggtatccgtgactgtctggggctgggacatgttacagccccagacagcattgggaatgcaggggaggaggacacttggatatggaataggcagctagcagggtctgtctcaggcaggaaaccgaggctcagagaagtcaattcacttggccaaggtcagcctcgcctccctcaggagcccctgccctgaatgctccatgtgttacccccctgatgaccagtgatgtttcctgggtgcttcctgtgggctgagcctcaggcagggctcttgctgtggatcagacatcgcatagtcacagcgaccctgtgatgtgggagcactccccgtggtgtacactggccggtgctgagggctggaggatctcttggatacccggggtccgacccaccgttgatcacaggcctgtgggtaccacgctgtgcatctaggccgctctcccggccgtgaccctcagccgccctctgaggaggccgccgtggcattttatgcccaagaaactgggtccatgaggagcaggtggtggctgaaggttgaagagctgggctccagcactttctctccgctttccctctcagtgggcagctggaaccctagcttgccctgagcgcctcagtttctgtctccagagcaacccatagcacacctgttctccttaaccttctatagcagaaacctcacctcaccttgcctgtggggcctctagagccttctggaatggggagggggtcagggctgcctctttcagggcctgaatggttctgaagagctgttgtccacccaggcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatcttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgccagggcctggggcagccccagttggggccccactcctgcatccaccacctgcccagtcctggcccgcacaacttccccctcgggctccactgccaggtaaggggacccgggggagggcagaggtctggactgagtgtcccagcagctcctgggctagagcaccaagaccgagtgctcctgggaagtaaagacataggatccaagaatgagggttcccccatggcctttgcggagctctgagggctccgggaaagtacagcccatgggtccaaggacctagtgggttaagagcgtttcccatgatcctcctgtgtgtgctcctgggattgctgggaaatgtggtcttagggccagagaagtagttttggagaagggcccccaaaggctcatgggaaacagcatatttgtaactagatggggccagaaggtgcttctgttgggtcccccaagggctgcctagaaaacttagtgcctctgggccctcctgggcccaagggcctactgggagatgcagtcccttccccactgcccctcaggtcagatgctgctgagcgggggtccccggggcccggtcccccagccgggcctgcagcccagcgtcatggaggacgacatcctcatggatctcatctgaatccccaacacccaataaagttcctttttaac

SEQ ID NO: 17418 - DNA, 1623 bp, Homo sapiens
atggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagacgttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccaggtcagatgctgctgagcgggggtccccggggcccggtcccccagccgggcctgcagcccagcgtcatggaggacgacatcctcatggatctcatctgaatccccaacacccaataa

SEQ ID NO: 17419 - DNA, 1212 bp, Homo sapiens
atggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctcctgcgctgctgcctccgccgcaccagggcctggggcagccccagttggggcccccactcctgcatccaccacctgcccagtcctggcccgcacaacttccccctcgggctccactgccaggtcagatgctgctgagcgggggtccccggggcccggtcccccagccgggcctgcagcccagcgtcatggaggacgacatcctcatggatctcatctgaatccccaacacccaataa

SEQ ID NO: 17420 - DNA, 881 bp, Homo sapiens
atggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccaggtcagatgctgctgagcgggggtccccggggcccggtcccccagccgggcctgcagcccagcgtcatggaggacgacatcctcatggatctcatctgaatccccaacacccaataa

SEQ ID NO: 17421 - DNA, 3184 bp, Homo sapiens
actggagtttggttctcgaggcggcggcagcgagcggcggcggctccggcggctcctcctcctcctttggtggcggcggcggcccgggaccgagacccggccccggctcccctctccgccaccccgcgcgcccccaaccccccggcgccgcggggaacatgcggctccggctcccggaggccggcgagtgagtgacccccgtcccccgcctcagcccgcccgcccgctggcccggccgcaaccccccgcctcgcccaggcaatgacagcggctccggcgtctccgcagcagatcagggaccggctgctgcaggccatcgacccccagagcaacatccggaacatggtggcggtgctggaagtcatctccagcctggagaaataccctattaccaaagaggcacttgaggaaacacgacttgggaagctcatcaacgacgtccgcaagaaaaccaagaacgaggagctcgccaagcgggccaagaagctgctgcggagctggcagaagctcatcgagccggcacaccagcatgaggcggcgctgcgggggctggcgggggccaccggctctgccaacgggggcgcacacaactgccggccggaggtgggggcggctggcccacccaggagcatccatgacctgaagagccgcaatgacctccagaggctgcccgggcagcggctggacaggctgggcagccgcaagcgccggggtgaccagcgtgacctcggccacccagggccgccacccaaggtctccaaagctagccacgaccccctggtccccaactcatcccccctccccaccaacgggatcagtgggagtccagagagcttcgccagctccctggatggcagtgggcatgcaggcccagagggcagccgcctggagcgtgacgagaatgacaagcacagtggcaagatccccgtcaacgccgtgcgaccgcacaccagctccccgggcctgggcaagccccctggaccctgcttgcagccaaaggcttcggtgctgcagcagctggacagggtggacgagactccggggcctccccatcccaagggaccccctcgctgctctttcagtcctcggaactcacggcatgagggctcctttgcccggcagcagagcttgtatgcacccaagggctccgtgcccagcccctcaccgcggccccaggcactcgatgccacacaggtgccgtcaccgcttccactggcacagccgtccacaccccccgtacggcggctcgagctgctgcccagtgcggaaagcccagtgtgctggcttgagcagcctgagagccaccagcggctggcggggccgggctgcaaggcagggctgtccccagccgagcccctcctgtcccgggcaggcttttccccagactcctccaaggcggacagtgatgctgcctcctcagggggctcggacagtaaaaagaagaagaggtaccgacctcgagactatacggttaacttggacgggcaggtggctgaggcgggcgtcaagcctgtccggttaaaagagcggaagctcacctttgaccccatgacgagacagatcaaacctctgacccagaaagagccagtgcgggcagacagccctgtgcacatggagcagcagtccaggacagagctggacaagcaggaggccaaggccagcctccagagccccttcgaacagacgaactggaaggagctgtcacgcaacgagatcatccagtcctacctgagccggcagagcagcctgctctcatcatcgggcgcgcagaccccaggggctcaccacttcatgtctgagtacctgaagcaggaggagagcacccggcaaggggccaggcagctgcatgtgctggtgcctcaaagcccgcccacggacctccctggtctgacccgggaggtcacacaggacgatctcgacagaatccaggccagccagtggccgggggtgaacgggtgtcaggacacacagggtaactggtatgactggacgcagtgcatatcgctcgatccgcacggcgacgacgggcgcttgaacattctgccttatgtctgcttggactgaccggcctgtcagccacaaagtgcattcccatcttgcagaagccgggtgggcgggcaggcaggtgggcaggtggccggggcccagctgcctcctgcgctgggaactcggggagtccggcccaggcgggagggagggggcgggagtcacgcggtctctctgcgctcttccctcaaaactctttttgtgaaatgctgctaccagtttactaacaaaattgcgaagaaggaccgcgtggaaggaaggacggcaaagtgagttcagaactctatagcaaaccagctataaaaagcgttagtccctcacccccaaagaggtgcggacactttccagcacctgaaagctggggcctcagttgcaggcaggcacagaaaacctgtgggagaggtcacctttaacacagcaacagaagcacgcatctcatctctcttgcattttctgttctttaatttggccctgagtgtcttgagacagtgggccatgccactgcctctgtttgctccctacccagccactgtcaggccagtgttgtctgtcatgtgccagaagcttctcagctgtggtgagccactggcattgggcaggcgggccagctggccagccagtgtgacccacactccatgggcagccacctgtttatatctggtttcagttataacccagtttttaaagaaatgctgcaaaaatttaagttttctcatgtttattttaaacaattcctcttccatcagaccaccagacaaaaaaacctttcctttcttcctcccttttcttttttcccttcctgtacacatctagaaaacttcacctttctagagtccccccaaaacaacacaaaagttattgtgggtgctactggttttatgctgtactgtggggcgagggggaagacctgtctgtacgctggaaacactcataaccattcctttagattcgtttgccttatggttatttgtcataaacgcgatttgcaaaaacaaggagccttagtgaatgtacagtacctagacttctgtgttctcaggacgcagaagggagcaactttgctatttggtccagtaagtggacaccttgtgatataaatgtggaaataaaaaaaaaaaaaaaaccatttgcacaaacc

SEQ ID NO: 17422 - DNA, 1447 bp, Homo sapiens
atgacagcggctccggcgtctccgcagcagatcagggaccggctgctgcaggccatcgacccccagagcaacatccggaacatggtggcggtgctggaagtcatctccagcctggagaaataccctattaccaaagaggcacttgaggaaacacgacttgggaagctcatcaacgacgtccgcaagaaaaccaagaacgaggagctcgccaagcgggccaagaagctgctccctggatggcagtgggcatgcaggcccagagggcagccgcctggagcgtgacgagaatgacaagcacagtggcaagatccccgtcaacgccgtgcgaccgcacaccagctccccgggcctgggcaagccccctggaccctgcttgcagccaaaggcttcggtgctgcagcagctggacagggtggacgagactccggggcctccccatcccaagggaccccctcgctgctctttcagtcctcggaactcacggcatgagggctcctttgcccggcagcagagcttgtatgcacccaagggctccgtgcccagcccctcaccgcggccccaggcactcgatgccacacaggtgccgtcaccgcttccactggcacagccgtccacaccccccgtacggcggctcgagctgctgcccagtgcggaaagcccagtgtgctggcttgagcagcctgagagccaccagcggctggcggggccgggctgcaaggcagggctgtccccagccgagcccctcctgtcccgggcaggcttttccccagactcctccaaggcggacagtgatgctgcctcctcagggggctcggacagtaaaaagaagaagaggtaccgacctcgagactatacggttaacttggacgggcaggtggctgaggcgggcgtcaagcctgtccggttaaaagagcggaagctcacctttgaccccatgacgagacagatcaaacctctgacccagaaagagccagtgcgggcagacagccctgtgcacatggagcagcagtccaggacagagctggacaagcaggaggccaaggccagcctccagagccccttcgaacagacgaactggaaggagctgtcacgcaacgagatcatccagtcctacctgagccggcagagcagcctgctctcatcatcgggcgcgcagaccccaggggctcaccacttcatgtctgagtacctgaagcaggaggagagcacccggcaaggggccaggcagctgcatgtgctggtgcctcaaagcccgcccacggacctccctggtctgacccgggaggtcacacaggacgatctcgacagaatccaggccagccagtggccgggggtgaacgggtgtcaggacacacagggtaactggtatgactggacgcagtgcatatcgctcgatccgcacggcgacgacgggcgcttgaacattctgccttatgtctgcttggac

SEQ ID NO: 17423 - DNA, 1431 bp, Homo sapiens
atcagcgagcgcggcttttttgcttgcgaagccggctttggagagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctggtgaccttgggaaaggtgttgaaagtgatcgtcgtcatgcggagcctgttcattgatcgaacaatagtaaagggatataacgagaatgtctacacagaagatggcaagcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcaccttcccagacacgcaggaagcccacagaaggctcagctggttcctcactgcccagatgtgtacagctgctcctccctttcataaagcagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctggataa

SEQ ID NO: 17424 - DNA, 1281 bp, Homo sapiens
gagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctgcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcaccttcccagacacgcaggaagcccacagaaggctcagctggttcctcactgcccagatgtgtacagctgctcctccctttcataaagcagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctggataa

SEQ ID NO: 17425 - DNA, 1278 bp, Homo sapiens
gagagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctgcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcaccttcccagacacgcaggaagcccacagaaggctcagctggttcctcactgcccagatgtgtacagctgctcctccctttcataaagcagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctg

SEQ ID NO: 17426 - DNA, 3565 bp, Homo sapiens
ggcgggactaactagcaaacggggactagaaatagggatgctgaaaagcaacggggagagacgcagtcgtaacgcacttccggcggtctacgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggcctcctgtcctggaccccacgtctgcaaggaaaccctaggaccatggatacctctgtgattcacgctgagcccaagtccccacactggaaaactgggaaatggccagctgtgtgtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgaggcaggagaatcgtttgaacctgggaggcagaggttgcagtgagccaagatcacactattgcactccagcctgggcgacagggcaagactctgtctcaaaaaaaataaaaaactgaccatctagtccttgtcatctgggcaccctcacacatctccttaaccacacttaatctccaaataagtacgataacatagtcatagtcccacccaacatgatgcagttatcttgcatacaactgaagacaactaaccctttccccaacagagcccaccagcagtggtggagatgtcggtccatgagcgcacacacaagactgagggactgtcggccctcccaggtggtgtcaacacaacatcacacacaggtgggggggcctgatagcccagcacccatgatacagggcctaccaatgcttaaaaccacacccagggagcccacagaggcactcagtgggtggtggggtgatggatacacatctatcaggcacagggcggaggtgggcaccactgagttgcactcagcaaacacattgggtatcttgtgcccaaggcctgtatttgtggagctgatgttctagtgagagacagtaaatgtgacaaaagtaaaatatatcagatggtgagaaaacagaaaaatgagatcagaagtggagatgttggggccaggcacagtggcccaggcctgtaatcccatcactttgggaggtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgtttttttaaaaaaagaagtggaggtgtttacaccagcaaaatactcattttttaagtgtaattaagttgaagatcaaaaaatggaaatgtataattaaatcatacttagcaaatctaacacatgaaatgtaacatctgcatatggagaatcgtgttactttattgaaaaacattaaaagtttgagaactt

SEQ ID NO: 17427 - DNA, 1482 bp, Homo sapiens
ctacgcgaggaagatggctgcatcccagcagcaagcttcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttc

SEQ ID NO: 17428 - DNA, 985 bp, Homo sapiens
gtgttacgtcacagtgggcggaagtcgcggccgctgttttgaaatcgggccgcggggggtctctcaagctggttccaacgctgaggccccacagcctcccaattccgggcagacccctgacacctgctgtctggccccttccggcctgaagctgcagccgcgccatgtccacccctccgttggccgcgtcggggatggcgcccgggcccttcgccgggccccaggctcagcaggccgcccgggaagtcaacacggcgtcgctgtgccgcatcgggcaggagacagtgcaggacatcgtgtaccgcaccatggagatcttccagctcctgaggaacatgcagctgccaaatggtgtcacttaccacactggaacatatcaagaccggttaacaaagctacaggataatcttcgccaactttcagttctcttcaggaagctgagattggtatatgacaaatgcaatgaaaactgtggtgggatggatcccattccagtcgagcaacttattccatatgtggaagaagatggctcaaagaatgatgatcgggctggcccacctcgttttgctagtgaagagaggcgagaaattgctgaagtaaataaaaaactcaaacagaagaatcaacagctgaaacaaattatggatcaattacgaaatctcatctgggatataaatgccatgttggcaatgaggaactaagctgatatttaaatttcctgctttacacatgttataccattgttttttccctcaagtattttttccctgtgaagaagattatttatctgcttttattttagtcactaaaactaaagtttttatttttacattgtgatttttacattaaaatattaactttttttaatgctattttatgaaagattattgtaataaactttgatggggtttgtattttggttaatcttcatgaattgaataattgtttttttaaagcaaaataaagttttttaaataaatgttaa

SEQ ID NO: 17429 - DNA, 2022 bp, Homo sapiens
gcgccggtggcgggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgtatgctttttttttagtttaaatatactgtcagtgtaggtaggaaattatttctgtaaatccagttgcattttataatacttgagtgactaactgaattgaaacctattacaattaatagggttctcaaaggcctattcctattagaagaaataattttttttaataattgaaaaaatttaccacagccttgtctgattttaagaatagattgtgtgaagatttagaatggaaagcaaccatttcttcccttcaccttcctcttcttacagttccccaggagtcatttttaaccacttttaatttctgttggtaacctctgtgtttaggtaatatgcttatacaactatttcttgatgtatcagttttagacaatgtatcttctgatttcaaaggtaatacaacatttaatgtgaaacatttagtgaatacagtaaaggagaaaataaaattgttagcattctacccagagataatatcaattcatattgtagtgtagatttttttaaagttcacatacacttttttgtaaaatgagaataatgtttatttcctgagatactgctgtattttttaattgctaatctgtattcttcaaatgaactgagaattccatttttccatc

SEQ ID NO: 17430 - DNA, 931 bp, Homo sapiens
gcacctgcgtcagctcgctctgcgcgtgcgccggtggcgggactctggggaaaatggctgcgtcttcgagtgggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaa

SEQ ID NO: 17431 - DNA, 1306 bp, Homo sapiens
atgaagctgctctggtggtgtgactggcttccagaaaggtctcatgtgttcactcagagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattg

SEQ ID NO: 17432 - DNA, 911 bp, Homo sapiens
cttcgagtggtgagaaggagaaggagcggctgggaggcggtttgggagtggcgggtggtaacagcacacgagagcggctgctgtctgcgcttgaggacttggaggtcctgtctagggccgggtgtggtggctcacgcctataatccgagcactttgggaggccaaggcgggcggatcattggaacttcttcacagaatgaagctgctctggtggtgtgactggcttccagaaaggtctcatgtgttcactcagagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacgg

SEQ ID NO: 17433 - DNA, 2402 bp, Homo sapiens
ttcacgttaagtcttacaagagcatgttaaacattaaaacataagattgtttctggtcaataaggggtctataaaaaataaagcaataaggtgtcttgttcaattttatgccttaattcaaaaagaaacgaagaaacggaaccctcagctacgacttttaaaagtcagtaacgggtggatgggaggagtcaaacatacgtaggcgcaacagcgagggatcggtctgaggcggagctagaatttcgttaaaggacagctcttacagccaatcaaggacagagtcggtggcttcttcccggaggagaccggaagttggtttcggctgcagaggggaaggcggctaccagtgtaaagccagagctgaggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatgtttctttttctttttttccttttgataatagcatcatatattagttcattttcttttggacagtcttaagagaagtttcactaaaaatgtaaacagctttaatcttgactccaaatttttcaattatgagatgtcataggcagtaatttcgctgtataacaagcatagacaaatgagtgtccctgcactaagaagaatcactttaaaaagcaaagtgttagctgctgttgtatgggacattcctatgttttagagttgcagtaaaactttgatgataacctcaataatagcaaagttttcgtctttgaaaaggggatttagcatttgctttaagaatgatagataaatggatattaagctctctacatgtaaaactatgaaatctttagacttattccattaaaaattttgcttaagctccaaaaagtagcataacatgttgatagagaggagcccagtagagttataaaatagaaacttcattttttcctcatgactgcttctgtaaacccactagctcagtcttttctccctatcctgaatggactcttgcagggaagtcccataaattgttgtttttttttccagtcactcaggtaataagtcctttggtcactttaagttacagacattaattttagtaattaagatgtctgtgtcattagctatacattttctttaaagctaagctcagacttgtttaagtccacaatgggaaaggggtttgatggcagagactgctaggtgtctaccaaagattcttgctctttgaagatatgttgtcaagatgtggcaatccagccagggacatttccctactcccagcatctctgtgagaacatatgactaagtcgtaggcggtgaaatgtgggcataggaatccaggcttgccccataaacatttcttgcatgatcctccattctcttctcccagctgctggttggacggtcgtatccaggataagtttggaagccaccgaagatggcaaagattgtcagtctggttctttgaatgaccgtgaggactaagtcttcctttcagtaactccactctgcccctagctaattggactttatatgagcactttcttctcttcttcccccgactgtccatctgctcttccaccaaggtgttagtggagagttgaccttgtgtctgaggatctctgcctgccgttttcttaatgtaggcccgtggttcttaaagtgtgtggtcctggaccagcagcattggtatcacttggggacttactagaaataaaagttttagtataatccgtaggttcagaaaaataaaaaataaatgagggtt

SEQ ID NO: 17434 - DNA, 1382 bp, Homo sapiens
ttttcttccggaccccgcagcttcctctgtgctgggctgggaactggggaggcatggctgagttcggcctccaaaggcggtctttcgtctttctctcccgagtctctccgagagtgcggtctctccgagagcgcggaggcctcggggtggacagcctggaggagggggctctaagcgtggcagtctcggggcttcctccgtgttgggacgccgagccggagtggaggttgggagacctggcgtctagtccccgcgccgctgtttttctaagctgtgtggccttgggcgagtcatttgccctctccggctctttgtaacatgagagtagccctccctgcccttccttcttctgggagcagttatgaaacagctgaggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatgtttctttttctttttttccttttgataatagcatcatatattagttcattttcttttggacagtcttaagagaagtttcactaaaaatgtaaacagctttaatcttgactccaaatttttcaattatgagatgtcataggcagtaatttcgctgtataacaagcatagacaaatgagtgtccctgcactaagaagaatcactttaaaaagcaaagtgttagctgctgttgtatgggacattcctatgttttagagttgcagtaaaactttgatgataacctc

SEQ ID NO: 17435 - DNA, 979 bp, Homo sapiens
gatctataaaatgagattacaggagatgttttgaaagacatgttcccattagaaatgtccatgtgatggctgggtgctgtggctcatggctgtaatcccagcactttcggaggctgaggctggcggatcacctgagaaacgaagaaacggaaccctcagctacgacttttaaaagtcagtaacgggtggatgggaggagtcaaacatacgtaggcgcaacagcgagggatcggtctgaggcggagctagaatttcgttaaaggacagctcttacagccaatcaaggacagagtcggtggcttcttcccggaggagaccggaagttggtttcggctgcagaggggaaggcggctaccagtgtaaagccagagctgaggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaaca

SEQ ID NO: 17436 - DNA, 2223 bp, Homo sapiens
gtagagtgcgcgacgcttttggcgacccgacctctggctaacctacccccggagccatggcctctgctggggtggcagccgggcgacaggcggaggatgtattgccgccaacgtccgaccagccgctgcctgacaccaagccgctgccgcctcctcagccgccgccggtccctgcgcctcaaccgcagcagtcgccggcgccacggcctcagtcacctgcccgcgcgagggaggaagagaactactcctttttacctttggttcacaacatcatcaaatgcatggacaaggacagcccggaggtccaccaggacctgaacgccctcaaaagcaagttccaggagatgcgcaagctcatcagcaccatgcccggcatccacctgagccccgaacagcagcagcagcagctgcagagcctccgggagcaagtcaggaccaagaatgagcttctgcaaaagtacaagagcctctgcatgttcgaaatccccaaggagtagagtgaggctgacttccttagaaagagggggaagccaatggcctgtctccccactaccatccccaaacgctccttggggcgtggttcctgtggaccccagctcagctcgtcaagctgcaggggcggggctcctgtgctgctgcgcgcgcttcgcctgtgcgggagccagcgcagagcttggctgcgccgggggttcctcgtgtagatccatatgtctagatgcataataactggagtgcctgctggtggaagtcagaatgctcctggaggctgcagagggggtggaggactctcccctgcctctggggagggggccatctgctgcgcccggccccactgacagatctgaagagcacagtaggaagggaggcggctcctctttgcttccttccctctctctcctcccacccccataggatcagtgtgtaccaggtacacattgttcctgttaacagcagcttcttgaaacatttgcatagaattcactggacgaattaagcctgcactcatatggcatagaattgtgagagaatgttttgaaaggccagagggtggcctttttccccaaacagtttggttccttttatgtttgagccagtgaagggaactacgctttgggggcttcagcctagagccctgccaggcagcccctggctccaggttccctgcctcctagcgctctcctcgccttcagctcttgctcccttcctcgttcatcaccctcagtcagtgcccaagagtggccaaaccgcttcacatctgcagtgcttccccagggttgacaaggggccgtcctttccacacaggccagaagaggtcttcaggcgaaccgaccttcccccttctggcatttcagattccccttgctctggttaaaaggtctttccctcgtggcctttgcacttgcggcagcaacgtgtactacactgcagaagggttcagtatgcaccttgtgttgagagagaggcaaccctgggggccagttcaggtggtccccaaccataagctaggtctgaaagttacacagccaagtttgagctcttaaaagttgatgaacagcctcatttccccagcttccctgatttcttccagatgggacgttttatttgtgtgctctcccttgactgtcagattgaagtaagagcagttctctccgttgcctctcgaggaggaggtgcgaagtcctggagtattgtttgggtctcggaatgggcgcataacctgcgctgaccagtttaggggcttagcagatgcctgccagctgacctcgttggcaggagggttgggtggagatgtttttagcagagcttccattagtgtagacctgtagccacctgtcagaaggtgggtggcatattggggacctgggaatgtgtgaaggaggagatcaaatttcagtggctttggacagaaaagaaggctctggatttaagcgggtggtcacctgtgagaccaggtctaccttgggactgttatttaactgaatcagttatttccttgaaatttcacagtagtgggtgggcctgttttaaggctctgacagataccacgaaacatgaagcacgtggaactacaagacccccggggtctttctgagtgcaaggctgaaatggacaagggctcctcacgggggtggagggagccggagcctgccttgtgttccttttttgacttgtgacatttttcaaacacataattaaaaggacttatgctctgctgtctcagga

SEQ ID NO: 17437 - DNA, 1756 bp, Homo sapiens
gggacgccgggggccggggccagggctttccgggcttcggtgaggccgccgtgggccccatcttccggcggtcgccggagtttgtggtgattgttgctgccgccgccaccgccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaatagtctgatttaaa

SEQ ID NO: 17438 - DNA, 1498 bp, Homo sapiens
cctatctgtagatctgtttatcttcaatatagaaagagatttatttggaattgactcatgccattatggagggctgacaagtgccaagatgtgcagtcagcaagctggagacccaggagagctgacggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaa

SEQ ID NO: 17439 - DNA, 1482 bp, Homo sapiens
atgctcagtgggcaggacccgttagagtggcgagcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaa

SEQ ID NO: 17440 - DNA, 1336 bp, Homo sapiens
ccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaac

SEQ ID NO: 17441 - DNA, 315 bp, Homo sapiens
gagaccttgggggtgcaaatcgatgagagatgcctgtatatgatggatacccgcgggactgtcctcgtggaaagccgcatccgcgagccctaggtgctctccatttgaggaagttggctgggggagggggcttgccttgcggctgcgtcctgctccccgcgccctgcccccacctcccagcctctgctgccgctaaaccccggagagcggagcgtgcacgttgagattcctcggcgggcggcacaggcaccaagatgtccaaccgagtggtctgccgagaagccagtcacgccgggagctggtacacagcctcag

SEQ ID NO: 17442 - DNA, 6575 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacctgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 17443 - DNA, 7576 bp, Homo sapiens
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacctgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 17444 - DNA, 582 bp, Homo sapiens
gtaccttgggtgcgactgggcggaggtgacttggaagttcgcttctcggactgtaatactcatccttacctggcgccccgctccgagtttagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttc

SEQ ID NO: 17445 - DNA, 583 bp, Homo sapiens
aatactcatccttacctggcgccccgctccgagtttaggtatgaagacacagggagacgtcgggccacaagggaacccactgaggtggggaccaaagatggtggctctttgaattggagccaagcgtggtgggcacccgctgagttggcctgtcataaagacggagttgacactttatccatggggcatcctactttccctacctgtcaacagtttccctctagagtggcatattttcagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcacc

SEQ ID NO: 17446 - DNA, 582 bp, Homo sapiens
attaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaaatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgct

SEQ ID NO: 17447 - DNA, 582 bp, Homo sapiens; identical to SEQ ID NO: 17444

SEQ ID NO: 17448 - DNA, 916 bp, Homo sapiens
acatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtcccc

SEQ ID NO: 17449 - DNA, 582 bp, Homo sapiens; identical to SEQ ID NO: 17446

SEQ ID NO: 17450 - DNA, 916 bp, Homo sapiens; identical to SEQ ID NO: 17448

SEQ ID NO: 17451 - DNA, 916 bp, Homo sapiens; identical to SEQ ID NO: 17448

SEQ ID NO: 17452 - DNA, 7576 bp, Homo sapiens
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 17453 - DNA, 7576 bp, Homo sapiens
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcgtctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 17454 - DNA, 5648 bp, Homo sapiens
ccacggctccccgggagccatcttggttcccccagaaggcgggaggggcgtaccttgggtgcgactgggcggaggtgacttggaagttcgcttctcggactgtaatactcatccttacctggcgccccgctccgagtttagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatgtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatt

SEQ ID NO: 17455 - DNA, 582 bp, Homo sapiens; identical to SEQ ID NO: 17444

SEQ ID NO: 17456 - DNA, 583 bp, Homo sapiens; identical to SEQ ID NO: 17445

SEQ ID NO: 17457 - DNA, 583 bp, Homo sapiens; identical to SEQ ID NO: 17445

SEQ ID NO: 17458 - DNA, 582 bp, Homo sapiens; identical to SEQ ID NO: 17446

SEQ ID NO: 17459 - DNA, 582 bp, Homo sapiens; identical to SEQ ID NO: 17444

SEQ ID NO: 17460 - DNA, 583 bp, Homo sapiens
aatactcatccttacctggcgccccgctccgagtttaggtatgaagacacagggagacgtcgggccacaagggaacccactgaggtggggaccaaagatggtggctctttgaattggagccaagcgtggtgggcacccgctgagttggcctgtcataaagacggagttgacactttatccatggggcatcctactttccctacctgtcaacaatttccctctagagtggcatattttcagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcacc

SEQ ID NO: 17461 - DNA, 582 bp, Homo sapiens; identical to SEQ ID NO: 17444

SEQ ID NO: 17462 - DNA, 582 bp, Homo sapiens
attaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacctgggtcgcgaccgttactggtggcgcgcgcggggacttaaaatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgct

SEQ ID NO: 17463 - DNA, 916 bp, Homo sapiens; identical to SEQ ID NO: 17448

SEQ ID NO: 17464 - DNA, 7576 bp, Homo sapiens; identical to SEQ ID NO: 17453

SEQ ID NO: 17465 - DNA, 6506 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacctgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 17466 - DNA, 583 bp, Homo sapiens; identical to SEQ ID NO: 17445

SEQ ID NO: 17467 - DNA, 7576 bp, Homo sapiens
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgcgctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 17468 - DNA, 3751 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacctgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgtt

SEQ ID NO: 17469 - DNA, 583 bp, Homo sapiens; identical to SEQ ID NO: 17445

SEQ ID NO: 17470 - DNA, 582 bp, Homo sapiens; identical to SEQ ID NO: 17446

SEQ ID NO: 17471 - DNA, 7576 bp, Homo sapiens; identical to SEQ ID NO: 17452

SEQ ID NO: 17472 - DNA, 582 bp, Homo sapiens; identical to SEQ ID NO: 17444

SEQ ID NO: 17473 - DNA, 916 bp, Homo sapiens; identical to SEQ ID NO: 17448

SEQ ID NO: 17474 - DNA, 916 bp, Homo sapiens; identical to SEQ ID NO: 17448

SEQ ID NO: 17475 - DNA, 582 bp, Homo sapiens; identical to SEQ ID NO: 17446

SEQ ID NO: 17476 - DNA, 916 bp, Homo sapiens; identical to SEQ ID NO: 17448

SEQ ID NO: 17477 - DNA, 582 bp, Homo sapiens; identical to SEQ ID NO: 17444

SEQ ID NO: 17478 - DNA, 7576 bp, Homo sapiens; identical to SEQ ID NO: 17452

SEQ ID NO: 17479 - DNA, 1172 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacctgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccacacagaggaggcctcctcagctgccagaagaggtgccactgtagaggc

SEQ ID NO: 17480 - DNA, 582 bp, Homo sapiens; identical to SEQ ID NO: 17446

SEQ ID NO: 17481 - DNA, 583 bp, Homo sapiens; identical to SEQ ID NO: 17445

SEQ ID NO: 17482 - DNA, 6506 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 17483 - DNA, 1172 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccacacagaggaggcctcctcagctgccagaagaggtgccactgtagaggc

SEQ ID NO: 17484 - DNA, 6506 bp, Homo sapiens; identical to SEQ ID NO: 17482

SEQ ID NO: 17485 - DNA, 1172 bp, Homo sapiens; identical to SEQ ID NO: 17483

SEQ ID NO: 17486 - DNA, 1172 bp, Homo sapiens; identical to SEQ ID NO: 17483

SEQ ID NO: 17487 - DNA, 3751 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcgtctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgtt

SEQ ID NO: 17488 - DNA, 6575 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcgtctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 17489 - DNA, 3751 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgtt

SEQ ID NO: 17490 - DNA, 6506 bp, Homo sapiens; identical to SEQ ID NO: 17482

SEQ ID NO: 17491 - DNA, 3751 bp, Homo sapiens; identical to SEQ ID NO: 17489

SEQ ID NO: 17492 - DNA, 6506 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgcgctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 17493 - DNA, 6575 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 17494 - DNA, 5648 bp, Homo sapiens
ccacggctccccgggagccatcttggttcccccagaaggcgggaggggcgtaccttgggtgcgactgggcggaggtgacttggaagttcgcttctcggactgtaatactcatccttacctggcgccccgctccgagtttagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatgtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcgtctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatt

SEQ ID NO: 17495 - DNA, 5648 bp, Homo sapiens
ccacggctccccgggagccatcttggttcccccagaaggcgggaggggcgtaccttgggtgcgactgggcggaggtgacttggaagttcgcttctcggactgtaatactcatccttacctggcgccccgctccgagtttagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatgtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgcgctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatt

SEQ ID NO: 17496 - DNA, 850 bp, Homo sapiens
gaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctacca

SEQ ID NO: 17497 - DNA, 850 bp, Homo sapiens; identical to SEQ ID NO: 17496

SEQ ID NO: 17498 - DNA, 3751 bp, Homo sapiens; identical to SEQ ID NO: 17487

SEQ ID NO: 17499 - DNA, 5648 bp, Homo sapiens; identical to SEQ ID NO: 17494

SEQ ID NO: 17500 - DNA, 6575 bp, Homo sapiens; identical to SEQ ID NO: 17493

SEQ ID NO: 17501 - DNA, 5648 bp, Homo sapiens; identical to SEQ ID NO: 17454

SEQ ID NO: 17502 - DNA, 5648 bp, Homo sapiens; identical to SEQ ID NO: 17454

SEQ ID NO: 17503 - DNA, 1172 bp, Homo sapiens; identical to SEQ ID NO: 17483

SEQ ID NO: 17504 - DNA, 6506 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcgtctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 17505 - DNA, 5648 bp, Homo sapiens; identical to SEQ ID NO: 17454

SEQ ID NO: 17506 - DNA, 6506 bp, Homo sapiens; identical to SEQ ID NO: 17504

SEQ ID NO: 17507 - DNA, 850 bp, Homo sapiens
gaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgcgctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctacca

SEQ ID NO: 17508 - DNA, 850 bp, Homo sapiens; identical to SEQ ID NO: 17496

SEQ ID NO: 17509 - DNA, 3751 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgcgctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgtt

SEQ ID NO: 17510 - DNA, 6575 bp, Homo sapiens; identical to SEQ ID NO: 17488

SEQ ID NO: 17511 - DNA, 1172 bp, Homo sapiens; identical to SEQ ID NO: 17483

SEQ ID NO: 17512 - DNA, 1172 bp, Homo sapiens; identical to SEQ ID NO: 17483

SEQ ID NO: 17513 - DNA, 850 bp, Homo sapiens; identical to SEQ ID NO: 17496

SEQ ID NO: 17514 - DNA, 850 bp, Homo sapiens; identical to SEQ ID NO: 17496

SEQ ID NO: 17515 - DNA, 6575 bp, Homo sapiens; identical to SEQ ID NO: 17493

SEQ ID NO: 17516 - DNA, 3751 bp, Homo sapiens; identical to SEQ ID NO: 17489

SEQ ID NO: 17517 - DNA, 3499 bp, Homo sapiens
gaagccagacagctggctcgagcctctcctgctcagcaccatggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcaggaatattccacacaagaaaacggcacagatgattccgcagcgtccagctccctgggggagaacaagcccaggagcctgaagactccagaccaccccgaggggaacgaggggaacggccctcggccgtacgggggcggagctgccagcctgcggtgcagccagcccgaggccgggagggggctgtcgaggaagcccctgagcaaacgcagagagaaggcctcggagggcctggacgcgcagggcaagcctcggacccggagcccggccctgccgggcgggagaagccccggcccctgcagggcgctagaggggggccaggccgaggtccggctgcgcagaaacgccagctccgcggggaggctgcaggggctggcggggggcgccccggggcagaaggagtgcaggcccttcgaagtgtacctgccctcgggaaagatgcgacctagaagccttgaggtcaccatttctacaggggagaaggcgcccgcaaatccagaaattctcctgactctagaggaaaagacagctgcgaatctggactcggcaacagaaccccgggcaaggcccactccggatggaggggcatctgcggacctgaaggaaggccctggaaatccagaacattcggtcaccggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactgaatgcccaacactgcatctctcttcctgcttctggccttgtatcttgcattcacactcaatagtcacggaatgccgactaggtgctagctgctatgggaaatgcaaaaataacaaaatagttactgtgcccacggagcctacccgattatagcagaggtaagttaggaacgaacatgttagtcaatccgggtgaagacatgtactgatgacacaccatggatttcagaggaggaagtacggagtcgttgcataatccgcccctggtgggtggcactctcaggtgctcctgaacagaagatttggccctcattttccctcagaaccccacggcaaggatatatgtccccttgttctctctgcttctgtcttgaggatatgggaagcctagagaaacgcaagcagactggattgggatagaagtatttgtgtacctggattaatgaactatgattttttttttttttttttgagaccaaatcttgctctgtggcccaggctggagtgcagtggcacgatctcagctcactgcaacctccacctcccaggttcaagcgattctcctgcctcagcctcctgagcagctgggattacaggtgcgtgccaccacaccaggctggttttcttgtatttttagtagagacgggggtttcaccatgttagccaggctggtctcgaactcctgacctcaggtgatccacccgcctcagcctcccaaagtgctgggattacaggcatgagccactgtgcccggcctatgattcttttttttttttttttttgagacaaagttttgctcttgtcacccaggctggagtgcagtggtgcaatcttggctcgcaacctccgcctcccaggttcaagagattctcctgcctcagcctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgccgggccatgattcttaagagaattgactgggcctcatgaataaaaaaattagaaaatct

SEQ ID NO: 17518 - DNA, 2959 bp, Homo sapiens
gaagccagacagctggctcgagcctctcctgctcagcaccatggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcaggatatggggtcttgctatgttgcccaggttggtctcgaactcctgatctcaaacaatcctcccatctttgcctccgaaactgctgggattacaggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactgaatgcccaacactgcatctctcttcctgcttctggccttgtatcttgcattcacactcaatagtcacggaatgccgactaggtgctagctgctatgggaaatgcaaaaataacaaaatagttactgtgcccacggagcctacccgattatagcagaggtaagttaggaacgaacatgttagtcaatccgggtgaagacatgtactgatgacacaccatggatttcagaggaggaagtacggagtcgttgcataatccgcccctggtgggtggcactctcaggtgctcctgaacagaagatttggccctcattttccctcagaaccccacggcaaggatatatgtccccttgttctctctgcttctgtcttgaggatatgggaagcctagagaaacgcaagcagactggattgggatagaagtatttgtgtacctggattaatgaactatgattttttttttttttttttgagaccaaatcttgctctgtggcccaggctggagtgcagtggcacgatctcagctcactgcaacctccacctcccaggttcaagcgattctcctgcctcagcctcctgagcagctgggattacaggtgcgtgccaccacaccaggctggttttcttgtatttttagtagagacgggggtttcaccatgttagccaggctggtctcgaactcctgacctcaggtgatccacccgcctcagcctcccaaagtgctgggattacaggcatgagccactgtgcccggcctatgattcttttttttttttttttttgagacaaagttttgctcttgtcacccaggctggagtgcagtggtgcaatcttggctcgcaacctccgcctcccaggttcaagagattctcctgcctcagcctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgccgggccatgattcttaagagaattgactgggcctcatgaataaaaaaattagaaaatct

SEQ ID NO: 17519 - DNA, 1279 bp, Homo sapiens
gaagccagacagctggctcgagcctctcctgctcagcaccatggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcagggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgaccacagtccccaacatggcctgggttcctgggaggaacgggattatacccaacatagcatgcagggccctaagcagggggttccttgtttccttgttgtcaggacagtgtaa

SEQ ID NO: 17520 - DNA, 1713 bp, Homo sapiens
atggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcagggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactga

SEQ ID NO: 17521 - DNA, 2984 bp, Homo sapiens
gaagccagacagctggctcgagcctctcctgctcagcaccatggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcagggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatggtgagtccagcggtaatggtgtgtgctggcctggggttgttgcagtgttcccttgtgctgttgacttgaggggccctatttagaagacaaaaaaaaaaaccaaacacctggagcaaagttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactgaatgcccaacactgcatctctcttcctgcttctggccttgtatcttgcattcacactcaatagtcacggaatgccgactaggtgctagctgctatgggaaatgcaaaaataacaaaatagttactgtgcccacggagcctacccgattatagcagaggtaagttaggaacgaacatgttagtcaatccgggtgaagacatgtactgatgacacaccatggatttcagaggaggaagtacggagtcgttgcataatccgcccctggtgggtggcactctcaggtgctcctgaacagaagatttggccctcattttccctcagaaccccacggcaaggatatatgtccccttgttctctctgcttctgtcttgaggatatgggaagcctagagaaacgcaagcagactggattgggatagaagtatttgtgtacctggattaatgaactatgattttttttttttttttttgagaccaaatcttgctctgtggcccaggctggagtgcagtggcacgatctcagctcactgcaacctccacctcccaggttcaagcgattctcctgcctcagcctcctgagcagctgggattacaggtgcgtgccaccacaccaggctggttttcttgtatttttagtagagacgggggtttcaccatgttagccaggctggtctcgaactcctgacctcaggtgatccacccgcctcagcctcccaaagtgctgggattacaggcatgagccactgtgcccggcctatgattcttttttttttttttttttgagacaaagttttgctcttgtcacccaggctggagtgcagtggtgcaatcttggctcgcaacctccgcctcccaggttcaagagattctcctgcctcagcctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgccgggccatgattcttaagagaattgactgggcctcatgaataaaaaaattagaaaatct

SEQ ID NO: 17522 - DNA, 1888 bp, Homo sapiens
atggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcagggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgaccacagtccccaacatggcctgggttcctgggaggaacgggattatacccaacatagcatgcagggccctaagcagggggttccttgtctttccttgttgtcaggacagtgtaatttagcccctcttaatgctaatgctcaggatttttttccctatctgatttttctccgtagttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactga

SEQ ID NO: 17523 - DNA, 2273 bp, Homo sapiens
agacagctggctcgagcctctcctgctcagcaccatggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcaggaatattccacacaagaaaacggcacagatgattccgcagcgtccagctccctgggggagaacaagcccaggagcctgaagactccagaccaccccgaggggaacgaggggaacggccctcggccgtacgggggcggagctgccagcctgcggtgcagccagcccgaggccgggagggggctgtcgaggaagcccctgagcaaacgcagagagaaggcctcggagggcctggacgcgcagggcaagcctcggacccggagcccggccctgccgggcgggagaagccccggcccctgcagggcgctagaggggggccaggccgaggtccggctgcgcagaaacgccagctccgcggggaggctgcaggggctggcggggggcgccccggggcagaaggagtgcaggcccttcgaagtgtacctgccctcgggaaagatgcgacctagaagccttgaggtcaccatttctacaggggagaaggcgcccgcaaatccagaaattctcctgactctagaggaaaagacagctgcgaatctggactcggcaacagaaccccgggcaaggcccactccggatggaggggcatctgcggacctgaaggaaggccctggaaatccagaacattcggtcaccggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagagattctcctgcctcagcctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgccgggccatgattcttaagagaattgactgggcctcatgaataaaaaaattagaaaatctg

SEQ ID NO: 17524 - DNA, 4496 bp, Homo sapiens
ggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacaggcctgtta

SEQ ID NO: 17525 - DNA, 4505 bp, Homo sapiens
ggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggaggtaaccccagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacaggcctgtt

SEQ ID NO: 17526 - DNA, 4343 bp, Homo sapiens
gccggcggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacaca

SEQ ID NO: 17527 - DNA, 4091 bp, Homo sapiens
gcaattacagacagttgcacttcaaggggacccttctttcacactacatccttctgtttttagactttttttgcgtttgaaaatgtgttttttgaggtggaatacccaactgacccctcatctctcctctctctctgctgccctgcagtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaa

SEQ ID NO: 17528 - DNA, 1842 bp, Homo sapiens
cgtcattgctgtgaatgggctggacggaggaggggccggcgaaaatgatgatgaaccagtgctcgtgtccttatctgcggcacccagtccccaaagtgctgggattacagacgtgagccactgcacccagcccattgtaactaaccatttttaagtgtatggttcagtggtattaaatacattcataatgtgtacagccatcactgccatccatctccctttcttttgatctcgtaaaactgaaactatccccattaaacagtaacttcccatttggcccttccgccagcctgtagcaactgccattctactttctgtctctatgattttgactaagtgcaatcatgaattgtcttttgtgacaggctgttgcactaagcatagtatcacttccttcatccattgatggacataggttgcttccacattctactgttgtgaatgcacttatcaacacctgtgtacaaatacctgagaccctgcttccaattcttttgggtatatgcccagcagtggaattgctagatcatatggtaattctatttttaagtaagtaagtgttggaggaacctccatactgtttttcatagcagctgcaccattttgcatttctaccacagggcacaagggctccagtttctctgtatcctcaccaatactttcttaaaaatttaattttacagtagccactccagtgggtttgaggtgtatctcactgtggtctccctcatgactagtgatattgagctcttttcatgtgctgttggccatttgtatatcatctttggaaaaatgtctgttcaaatctttcttttacctattcttgagtcaagtttggttttttgttgttgagttttagaagttctctgtgtattccggatatcacttctttatcaaatatgtgatttgcaaatatttttaaagagttttatagtcttagctcttacatttaagtaagtctttgatccgttttatttttgtaaatggtgtgacgttggggggtccaccttcattcttttgcatgtagatatacaggcttggcttctgatatccatttactctcttgattgattggcagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtc

SEQ ID NO: 17529 - DNA, 2137 bp, Homo sapiens
gggccggcggcggcggcggcgcgcggaggagaccgcagtgcggccggcgctaggacccgcgggggcctcccaggccgcggcgcctcccgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgagcagaaaacaggaagaaccaggctcggtccagtggcacccagctccctacctcctgtgccagccgactggcctgtggcaggccattcccagcgtccccgactgtgaccacttgctcagtgtgcctctcacctgcctcagtttccctctgggggcgatggcggggcgaggctctctggtttcctggcgggcatttcacggctgtgattctgctgaggaacttccccgggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggaagttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaaggactct

SEQ ID NO: 17530 - DNA, 1914 bp, Homo sapiens
gggccggcggcggcggcggcgcgcggaggagaccgcagtgcggccggcgctaggacccgcgggggcctcccaggccgcggcgcctcccgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgagcaggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggaagttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaaggactct

SEQ ID NO: 17531 - DNA, 2078 bp, Homo sapiens
agcaaaatcaagcagttggttagcgaagggattcggtgcagatggatggaccgtctgggctgcggagtccacgggcctgaaacgcggtcgctcctgacccgtcctccgcaaccctcgtcccaccaggccgcggttcccggagcaggccggcgggtggcaggaagacaccaggctgcagggggctggagaagcaacacccctctccctccccgccagagaactggagcgcggggacctcggttgcggatgctagctgcgagccgggttgctaggcgacatcgagagaggaagaggagaaagtcttcatggggtgctagagcatcttaaatgtccctctcatgcagggacatttccctgctgaacgaagagaaggcagacctcggcgagggacccgtggtcagcagcagcttctggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggaagttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaaggactct

SEQ ID NO: 17532 - DNA, 3933 bp, Homo sapiens
aaagggggcagcaggaccgggcccaccagccatccgggctgcccacgcaaaccacagggccgaatccggagccgcccaaggccacacagctaagccgagtgcgtgaatgcttatgtgaccgtgtgaaggaggttcccaccgtgtggctgtgggggatggaaaaaggctacttggaaagatgtagaagaccttcgagtaaacagttacgtttcagaaacagagcctgctcagaatgtgtacttggtgggattctattcttagggacgcttctttcttctgagagacccgagctctgtggcgagtggcacaggcagggccccttcctttcctagttgggttctgacagctccgaggcagtggtttacacaaccaacacgaaacatttctacgatccacccgattcctcccctcattgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagacgtg

SEQ ID NO: 17533 - DNA, 3601 bp, Homo sapiens
gtaagtgctcagacattaagccgttgagtagaggcatgttttgcaatctctcgtttagctaccaattggagcagtttaacgtgcttgagtccccggcgtgatgtgttcatggacgaagttgccgatggatgttgtcaggtgttgcacctggagggcccagatggatcaatgaggcatttaaagtgtagaatctcaccctgaacccagactattcagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagacgtg

SEQ ID NO: 17534 - DNA, 1594 bp, Homo sapiens
tttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggtgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggctt

SEQ ID NO: 17535 - DNA, 758 bp, Homo sapiens
agtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggtgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtccc

SEQ ID NO: 17536 - DNA, 1287 bp, Homo sapiens
gcgtgatgtgttcatggacgaagttgccgatggatgttgtcaggtgttgcacctggagggcccagatggatcaatgaggcatttaaagtgtagaatctcaccctgaacccagactattcagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctctatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgca

SEQ ID NO: 17537 - DNA, 1336 bp, Homo sapiens
gaatacttcttgctggaagtccctcacccagagaccagtgctcccaacggcagagcagcgggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactgg

SEQ ID NO: 17538 - DNA, 1656 bp, Homo sapiens
agagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctc

SEQ ID NO: 17539 - DNA, 507 bp, Homo sapiens
gatattattgataataaggcctctgtaaccatggctagttctgacgtaaaaccaaaatcagtaagtcatgccaaaaaatggtcagaagagatagaaaatctgtacagatttcaacaagcaggatatcgggatgaaaccgaatatagacaagtgaaacaagtttctatggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactttcttgg

SEQ ID NO: 17540 - DNA, 625 bp, Homo sapiens
cctgctcgcggatcccgagtagagaacgcaagcacccacgcccgcctgcaagctcccgggcgcccccggcctctcctgctcggcggaacgaggataacccagtagagccggacccagggatattattgataataaggcctctgtaaccatggctagttctgacgtaaaaccaaaatcagtaagtcatgccaaaaaatggtcagaagagatagaaaatctgtacagatttcaacaagcaggatatcgggatgaaaccgaatatagacaagtgaaacaagtttctatggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactttcttgg

SEQ ID NO: 17541 - DNA, 2023 bp, Homo sapiens
acttttggtcgagcggagggcgcgcagctccaccgttgccaagacgccgcgtaaacacccgagcgcgcgcagccaggtgcgctccttggggctgctggctgctgcgtttgcggcgggaggtggtggccgcggtcccacgagagggggtatttttcgtcagccaagatgggttccaaaaggagaaatttgagctgtagtgaaaggcatcagaaattagtagatgaaaactactgcaaaaaattacatgtccaagctctaaaaaacgtcaacagtcaaatcaggaatcaaatggtgcagaatgaaaatgataaccgtgttcagcgcaagcaatttctcagattattacaaaatgaacaatttgagttggatatggaagaggccattcaaaaggcagaagaaaacaagagattgaaagaactccagctcaaacaagaagaaaaactggctatggaattggcaaaactgaaacatgaaagtctaaaggacgaaaagatgaggcaacaagtaagagaaaacagcattgagcttagagaattggagaagaaattaaaagcagcttacatgaataaagaaagggcagctcagattgctgaaaaggatgccattaaatatgaacaaatgaaacgtgatgctgaaatagccaaaaccatgatggaagaacacaagagaataataaaggaagagaatgctgcagaagacaaacgaaacaaagcgaaagcacagtactatcttgacttagagaaacaacttgaagaacaagaaaaaaaaaagcaggaagcttatgagcagctgctaaaagagaaactcatgattgatgaaattgttaggaagatctatgaagaagatcagttggaaaaacaacaaaagttagaaaaaatgaatgcaatgcgaaggtatatagaagagtttcagaaagagcaggctctctggagaaaaaagaaacgtgaggagatggaagaagaaaacagaaaaatcatagagtttgctaacatgcagcagcaaagagaagaagatcggatggcaaaagttcaagaaaatgaggagaaaaggctacagcttcagaatgcgttgacacagaaattagaagaaatgctgcggcaacgtgaagatttggaacaagtgcgacaagaattataccaggaagaacaagctgaaatatataagagcaagctaaaagaagaagcagaaaagaaattgagaaagcaaaaagagatgaagcaagattttgaagaacaaatggccttgaaggaattagtgctacaggctgcaaaagaggaagaggagaactttagaaaaactatgctagctaaatttgctgaggatgatcgaatagaattaatgaatgctcagaaacaaagaatgaagcagctggaacacaggagggctgtggaaaaacttattgaagagcgtcgccaacaattccttgcagacaaacaacgtgaactagaagagtggcagttgcagcaaaggcggcaaggatttattaatgcaattattgaagaagaaaggctaaaacttcttaaagagcatgctacaaacttactaggctatctccctaaaggagtatttaaaaaagaggatgatattgatctgcttggtgaagagttcaggaaagtatatcaacaaaggagtgaaatttgtgaagagaaatgatatcatcaaaattgggtaaagcatagattttttgcatgttaccactagatgtcagcataacttttgttttacagttcagtggcattaggtatccattgtctgtttggattttgtaaatcatcactgaatttcataacttgtaaacaattatcagatacaaattaattttaatcaagctgttatttttgtactgataatttcaaaatccgatttctacaacactacagagcactgtttgcatccccatcctcaagacagtatatttaccttgactaatacagaactctaccccaaagtgaactgccttctgtctgtgtttacgaactttacttacttgatttagccagggaaataaatatttggaattttc

SEQ ID NO: 17542 - DNA, 3147 bp, Homo sapiens
atttgaggtgttctgaccagaagaagacagagcggatgatcattcattcaccacgttgacaacctcgcctgtgattgacagctggagtggcagaaagccatgagatttggtagttgggtctgaggggcgctcttttttttccttttctttctttctttctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatc

SEQ ID NO: 17543 - DNA, 2659 bp, Homo sapiens
gagacatgcccgtttcaccttctaccctcgggagaatgcttctctttctctctttctttcttctttccttcttgccaaaggagcctgaatttctaaactagttgatagggacacaagttagggcaagatcattcatcccagacgagtctcgctgagaattctgtattttttacttaaagctttaattttaaaataagaaaaactcagctttatagatgcaaggccaccgaattccgggtggaaggacccagctgtattgaccttatataagctcggtgccttgccgttctcccatttgcccgcctggcctcctgaaccttctttctctcctgtttgtcatgcagtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccagggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaa

SEQ ID NO: 17544 - DNA, 2373 bp, Homo sapiens
aagccatgcatgttacctccaacctcagattttctctctgtctgagtgtctgtttgcagataacttaaaatcacccatctgcatccccactcaccctccagaaagcaaacgtggagagctcactctgcagaataaaatcaagaacaccacggttgtagctgctgtggactcggcggtctgagcagcctccccgagagccgtagttgctagtagaaattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtc

SEQ ID NO: 17545 - DNA, 3084 bp, Homo sapiens
atttgaggtgttctgaccagaagaagacagagcggatgatcattcattcaccacgttgacaacctcgcctgtgattgacagctggagtggcagaaagccatgagatttggtagttgggtctgaggggcgctcttttttttccttttctttctttctttctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccagggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtc

SEQ ID NO: 17546 - DNA, 579 bp, Homo sapiens
acagatcatagcggaatcagaatttccagcaaggaaaatcttttcatggtgaattaagtggtggatgaagaaaaatggtgatgaaaaaagccctcttggaacagagatcatgatgacacggcatctactcgttcaggaggaaccccaggcccttccagcggtggccacacgtcacacagtggggacaacagcagtgagcaagcacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgag

SEQ ID NO: 17547 - DNA, 1499 bp, Homo sapiens
atgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaagcacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccagggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcct

SEQ ID NO: 17548 - DNA, 558 bp, Homo sapiens
ggagaagtcagctccaggaatgaagtcactgctgacattttacaaatgtggttcagagctgctgcctgctgccgtgtggtcggccggcggttctccaagtttgtttagtgatctcaaaagtaaaaaaggaaagaaattctcgagagaccacattgaggtgactatatcaaattgcggagtgaatggaaatgctaaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaat

SEQ ID NO: 17549 - DNA, 1913 bp, Homo sapiens
gttgacagtcggccccacggccatggacgtcctttccccaagttagctgagcgcctgccaccgagatcccccgagcctgggcttcgcgcggccgcctaggaggaacccgcaggaaccagccctccccaactctccgcccggcgcctttctcctccaccggatcctggatgtgcagtggaggggacgagggcttgtcgggtgggaaacttaattcaaaatggctgctggaaacgcttgggttttattcgtagcaaatgttgccaatttctccggccagatacgctaaaccgatcctcagataccgtccatggctcagggcctccgacttcagggctccaggaggaaggggagacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttg

SEQ ID NO: 17550 - DNA, 2392 bp, Homo sapiens
cggaatccacctctccgcctgtgcaacacacactttacacacgcacggggactgcaagcgggcagcatcgatcgtggctcctttaagacaaactcagacagacattttttttaaccctccttctctaatctccttccagtgcagcacttgcaaagagggagagagagggagagaaagaaagagagagagagaagagagaaactgattaggaattaggactgattcaagggaagcgagcgctagggctttgtgcatttgaatattaacatttgaggtgttctgaccagaagaagacagagcggatgatcattcattcaccacgttgacaacctcgcctgtgattgacagctggagtggcagaaagccatgagatttggtagttgggtctgaggggcgctcttttttttccttttctttctttctttctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcaggcaagtcccccatagtgactgtattcaagtcacgcaagcgaaaaccatcctcaagccattcaccgggaggtccgctacctggtaaataaactgggagtgagtataggaacgcctggcaattaaaattaaaccagtttcgtttcataacaacactaatcaatttaacatcattataaaacgtttggagaaggtggaaaaaaaaagccaacagagaaaagtaactcttaaataatatgctcagttacaatattctttgtacacattcaatatattaatgttattttttttctgagtttgccttcccagctctttctgctactatgaccactccctggtgcatggcttggtgtggaattgctgtaaactttattacctgtcaaaagggcaaaggggtcaggattgcttgtgggactcagtaaagttcaaagacattcaatgaggtagagcttttgtgtgctttaataacccaaggcagcttacttctgaagcagcttttcatgtacagttaaaacacgggattcaggtagtggtataaatacatggttcttatttctcagaccttctcttgttaatatccatcttctggtgttcgactttttttttttttaataacagtctttttgttttgtttttaaattatgagc

SEQ ID NO: 17551 - DNA, 2321 bp, Homo sapiens
attggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattg

SEQ ID NO: 17552 - DNA, 3007 bp, Homo sapiens
accgcttggagggagtgtgctctgagttaagctggtctcttctggtcctggaaaaaaatgagtattgacaaggttgctggatctgcgcagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaacatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgattttt

SEQ ID NO: 17553 - DNA, 3050 bp, Homo sapiens
gcctttggctacatcggacccagatgactgcctcctcacttcctccctcccgattccgccgcggcccccaaagactctcggggtggccccttgtccgcaccgcttggagggagtgtgctctgagttaagctggtctcttctggtcctggaaaaaaatgagtattgacaaggttgctggatctgcgcagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaatacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttg

SEQ ID NO: 17554 - DNA, 3591 bp, Homo sapiens
tcccgctccccactcccgggatgtgtctccgccgtacgacgggctatggccaccacgacttccgggttccgtcatttcgttctcccgccgccgacccgcgccgccaaactgaggctcttcaataagccaggcagcagccaacctgccaacacctactgacactcactcatctcccagagagagaaagagagcgagagagagcgagcgcgagagagcgagcgcgagtgagagcgagcgagcgagcgagaaagagagagagggagagacaaaatacctaccaggaaagggggggaggaagtccaatttttgcaaactattcatttttttttcttgatttttctcactgctttctttgaacaatactttaaagagagaggatcgtattatagataccgcgggggcaaagctaaaaaaggggggaggggggaggaaaaaattcaagaagcagaaacccctcgcggagttttactggaagaaaaaaacgggtctgaaagattcctcctcttcatcatcatcaaccatcattcattcactaccttgacattccgggctttgattgacagctggagtggcaaaaagccatgaaacacgacagttcggttacatgtgggctgctgacgggccgctcgtaaccttcagttcgggggcttgacaatttttttcttctttttcttctttttcttttctttctttttttttccaactgaggggaagagaagagaaagagggggaaaggaggaccgaagaggaggaggaggggaggggggaggaggaggaggtggaggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttg

SEQ ID NO: 17555 - DNA, 2295 bp, Homo sapiens
cccgatgcctcctctcccttcaacgcttctgctgctgctcgctgcttgatgatggcggccagtattttaaaaaatagcaaaattattcatcggcttctttccctcccgtgcctctgcgtgtgtgcgagtgtgtgtgcgtgcgtgtgtgcgtgtctgggcgcgcgtgttccagcgctgtgcgagcgggcgggcggcgagtgcgtgtgagtggtgtgtgtgtgtgcgtgtgcaatcgttacacgctttcgcctcgctccagcttttaccccagcagcgcgattcccccggttctcctgctgccgctgctgcgccgctgccgccgtggctcgcgcggctcggggcgggcacgggctgcgtaggagccgccgccggggccgccgctggggccgcgctgccgcagccgctgcgccgccgcctagactactagcctgggctgcttgttttgtctctgaaattgacaaggacgcagggaatccgctgctaaataatgtttctgtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatggctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttag

SEQ ID NO: 17556 - DNA, 2738 bp, Homo sapiens
catctttatcccttcctctcttttctgttcgccctcttctccctgctctttttccctttccacccccctcctctgttctccctcacctcctgcgccccctcccccttcccgggttctgacagtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatggctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttga

SEQ ID NO: 17557 - DNA, 2917 bp, Homo sapiens
ggctcggcgcggcgcgctcctcctcgctcccgctccccactcccgggatgtgtctccgccgtacgacgggctatggccaccacgacttccgggttccgtcatttcgttctcccgccgccgacccgcgccgccaaactgaggctcttcaataagccaggcagcagccaacctgccaacacctactgacactcactcatctcccagagagagaaagagagcgagagagagcgagcgcgagagagcgagcgcgagtgagagcgagcgagcgagcgagaaagagagagagggagagacaaaatacctaccaggaaagggggggaggaagtccaatttttgcaaactattcatttttttttcttgatttttctcactgctttctttgaacaatactttaaagagagaggatcgtattatagataccgcgggggcaaagctaaaaaaggggggaggggggaggaaaaaattcaagaagcagaaacccctcgcggagttttactggaagaaaaaaacgggtctgaaagattcctcctcttcatcatcatcaaccatcattcattcactaccttgacattccgggctttgattgacagctggagtggcaaaaagccatgaaacacgacagttcggttacatgtgggctgctgacgggccgctcgtaaccttcagttcgggggcttgacaatttttttcttctttttcttctttttcttttctttctttttttttccaactgaggggaagagaagagaaagagggggaaaggaggaccgaagaggaggaggaggggaggggggaggaggaggaggtggaggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagtttt

SEQ ID NO: 17558 - DNA, 3687 bp, Homo sapiens
tcccgctccccactcccgggatgtgtctccgccgtacgacgggctatggccaccacgacttccgggttccgtcatttcgttctcccgccgccgacccgcgccgccaaactgaggctcttcaataagccaggcagcagccaacctgccaacacctactgacactcactcatctcccagagagagaaagagagcgagagagagcgagcgcgagagagcgagcgcgagtgagagcgagcgagcgagcgagaaagagagagagggagagacaaaatacctaccaggaaagggggggaggaagtccaatttttgcaaactattcatttttttttcttgatttttctcactgctttctttgaacaatactttaaagagagaggatcgtattatagataccgcgggggcaaagctaaaaaaggggggaggggggaggaaaaaattcaagaagcagaaacccctcgcggagttttactggaagaaaaaaacgggtctgaaagattcctcctcttcatcatcatcaaccatcattcattcactaccttgacattccgggctttgattgacagctggagtggcaaaaagccatgaaacacgacagttcggttacatgtgggctgctgacgggccgctcgtaaccttcagttcgggggcttgacaatttttttcttctttttcttctttttcttttctttctttttttttccaactgaggggaagagaagagaaagagggggaaaggaggaccgaagaggaggaggaggggaggggggaggaggaggaggtggaggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttg

SEQ ID NO: 17559 - DNA, 1238 bp, Homo sapiens
cccgatgcctcctctcccttcaacgcttctgctgctgctcgctgcttgatgatggcggccagtattttaaaaaatagcaaaattattcatcggcttctttccctcccgtgcctctgcgtgtgtgcgagtgtgtgtgcgtgcgtgtgtgcgtgtctgggcgcgcgtgttccagcgctgtgcgagcgggcgggcggcgagtgcgtgtgagtggtgtgtgtgtgtgcgtgtgcaatcgttacacgctttcgcctcgctccagcttttaccccagcagcgcgattcccccggttctcctgctgccgctgctgcgccgctgccgccgtggctcgcgcggctcggggcgggcacgggctgcgtaggagccgccgccggggccgccgctggggccgcgctgccgcagccgctgcgccgccgcctagactactagcctgggctgcttgttttgtctctgaaattgacaaggacgcagggaatccgctgctaaataatgtttctgtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaag

SEQ ID NO: 17560 - DNA, 854 bp, Homo sapiens
tgactgcctcctcacttcctccctcccgattccgccgcggcccccaaagactctcggggtggccccttgtccgcaccgcttggagggagtgtgctctgagttaagctggtctcttctggtcctggaaaaaaatgagtattgacaaggttgctggatctgcgcagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaatacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatggctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtaagcaggaaa

SEQ ID NO: 17561 - DNA, 2538 bp, Homo sapiens
cttttctgttcgccctcttctccctgctctttttccctttccacccccctcctctgttctccctcacctcctgcgccccctcccccttcccgggttctgacagtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattg

SEQ ID NO: 17562 - DNA, 1442 bp, Homo sapiens
aggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaacc

SEQ ID NO: 17563 - DNA, 4818 bp, Homo sapiens
cgggccgctcgtaaccttcagttcgggggcttgacaatttttttcttctttttcttctttttcttttctttctttttttttccaactgaggggaagagaagagaaagagggggaaaggaggaccgaagaggaggaggaggggaggggggaggaggaggaggtggaggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgattttttgttaggcttttgcgtttttaatggttttaggacaagactgcacaatgccaactctatacagtgttaaaagtaggtttttccccccagcagttgagtatattttaaactcatcaataatttttaaggtaatcatctatagcctttcaatgtctatttgacctataagttccaccagcagaaaacttctaaaggtacgaaactatgtgtacatgatgagccaggttgaaagatccccttgaacatgctcaacctcctttttagatgcatgacgttaaaaaatatatactttcagataaagcttttcatgggcatcctctgccagaataaaggacttttcagggttaattttacaacataagaaataatgtctgtgctcaaaggtaatttatctgcctgtgtttttcctctgcctgtcttactacaatattgttggatatgtaaatgaaaatttacatatgggtgttcatagataagtaaacaacttctatggagtttgaaattctgactttaaaagattacttaatcattaatattttataaattatattgtggtatatttttatttcagacacatccatgtgcagggatgctagtgtgatgatttgataactaaacttaaacttttttctgaaaacaaaacaaaacaaaatggacggtataatgccattttcaaaattttatgcaacattcctggaaatctataccattagcttattgatactgcacaaacaatgtctgctaaagtgtgcaaaaagggtgaggcatgtcccctcaattttcaaataaatatactatcctggaattttttaactcttaaattttgaatctttgtttagaaagaataatgtcatatactttggctagatatgtgatgtcaaccggctaaggaaattattcatcatctctgcaaacttaaacttggaagaaatccatagttattatttggggctcttccatctttccatttcagacagcatttatggaggttctatataaatgaacgaggaaatacacttctattgttttgtgttatatttagtcaggtagaatttttacaaatacatttcagtttaagtgttgtgttgctgtttaaacatagaaataatgcttctgacacaaactaacttaatagagaaattcagtgccacttgggaaagagagatagcttccctctcatttttgctattctattttacatgaagtctttttgtaaattttaaatatttgcctatttttactttaaatacttttatgtaaactatgaaaattccccattataaatcaactctcacatcaggtgggaaaaagaacctttttttctttccactcagtaaattctgaagggtttccttggcaattggctcgtgtttaggatgtgttttatgcaattatcaagttatctcattgaagtttagagaccagagctctcaactcttggttttaatgaataaagtcatctcatgcttagtttattcgtcaaacccacgtcctatcatgttaactttaaccttcttaaatatttggagatgaatgataattgtaatatttgtttgcattaccttgctctcccccacccccaaccccatgataacacagagaagtgatagatttgtccaatttttataatgctttttttacaccaccccggaaggcacttgctcctatctcgggtttactatttagtgtaaagagttccgatttgggtatatttaagaaagactcagctgtcaaaagcaaagaaactgggaatggtgttttgacaaccatatagtgttaaaggaaatactgtagtctgaataaaattgcttatgttctcc

SEQ ID NO: 17564 - DNA, 4818 bp, Homo sapiens; identical to SEQ ID NO: 17563

SEQ ID NO: 17565 - DNA, 1000 bp, Homo sapiens
ctctcattaaggaaggtaagagcgttgccttctcgccataatcatagtcctcttctcccagaataggatttgggaaattctggctaagtcctctgcctaccctcattgccccgctgatgtgtgacatcaacagaatttctccgcaacgtttgtcagtctccaacctcagagggctcacaaagcctcctcctgaatcctctctcagtcctccaacactaccaagaagaaaagcaattattcaggatggcatcttgctggggagaagcagcctccctgaggtagatgtgttctcctgtcacttaaagaaccacttctcctggtctgagtagtaagaggcgcatttgctgttgctgcaccatttgccaaggctctgagtttgaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatact

SEQ ID NO: 17566 - DNA, 791 bp, Homo sapiens
cagcagacagaggactctcattaaggaagaatttctccgcaacgtttgtcagtctccaacctcagagggctcacaaagcctcctcctgaatcctctctcagtcctccaacactaccaagaagaaaagcaattattcaggatggcatcttgctggggagaagcagcctccctgaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgata

SEQ ID NO: 17567 - DNA, 2415 bp, Homo sapiens
ccgtcagaaatctaaacccgtgactatcatgggactcaaaaccaggaaaaaaaataagtcaaaacgattaagagccagagaagcagtcttcatacacgcggccagccagcagacagaggactctcattaaggaaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatactatctgtgccagaggtaatgttagtaaatccatggtgttattttctgagagacagaattcaagtgggtattctggggccatccaatttctctttacttgaaatttggctaataacaaactagtcaggttttcgaaccttgaccgacatgaactgtacacagaattgttccagtactatggagtgctcacaaaggatacttttacaggttaagacaaagggttgactggcctatttatctgatcaagaacatgtcagcaatgtctctttgtgctctaaaattctattatactacaataatatattgtaaagatcctatagctctttttttttgagatggagtttcgcttttgttgcccaggctggagtgcaatggcgcgatcttggctcaccataacctccgcctcccaggttcaagcaattctcctgccttagcctcctgagtagctgggattacaggcgtgcgccactatgcctgactaattttgtagttttagtagagacggggtttctccatgttggtcaggctggtctcaaactcctgacctcaggtgatctgcccgcctcagcctcccaaagtgctggaattacaggcgtgagccaccacgcctggctggatcctatatcttaggtaagacatataacgcagtctaattacatttcacttcaaggctcaatgctattctaactaatgacaagtattttctactaaaccagaaattggtagaaggatttaaataagtaaaagctactatgtactgccttagtgctgatgcctgtgtactgccttaaatgtacctatggcaatttagctctcttgggttcccaaatccctctcacaagaatgtgcagaagaaatcataaaggatcagagattctggaatggtgtcattatttgcatagcaacattgcaatttgttttcctttggctacatcaacgtatcacctacactattatttatctaatatttctctttcaggcagctcatttaaactttttttggctttaattcctattgccatcctgagtggaaaaccagtatcattttccatagtagaggataactataacaacgaagataatgaaagtaatttttttaacctaagaaaatactaatggtcacagaaggctatgaacctgagacctgctctctttgtcaaacagagattaacaaggatcagagaaaagttaaaggctgtctttgacataactggaaggcttacaagagttttaaagaaattactttctcactatatgattcattgctatttaacggtgagtcagtaaaccacctaaaaatcatcttgtctcatcagaaacactagtgtaacataactgcatcattttctactaaagacaaaatttcaccaaaggggaaaaagaaaacacaggataaagagatgtattacacacatcgaaaaaaacaacatttaacaaaatattaaaatatttccccactcttctgatactgtcaagtcttactacttaaaataaggcttccacctctcccacttcaaacaaataaatgaattctaaaccaaagaaacttcatcaggcatttgggtacctcctcccctcaccacgaggtctctgctgaacctcaatcctgtacactgaggaacctgtggcttgaaccctacatccctccagaacccccagactg

SEQ ID NO: 17568 - DNA, 2851 bp, Homo sapiens
cagatatttgtctcaaagagtcccaggccaaacctcagggacctcagagcgtttagaaaaataacacctctgtgagcttggtccaggcagatcccatgcagagaggagtttgtccccttccagtccccgaggtcctggctattgccagcatggagtgacctgtgtcacctctgagtgccaggcaagggttcagcagctgacgactcagcttctgcaggatgctggcagcatagccagcgagatagttggaagccgtcagggcacagggaaggggccgagggtgccctgagtgtgcatggggggcagccctgctgcagtccaagcctttgattcccaagctatgtgcacagtttcctctggactctgccatgtggcccagccacccatacctggaataggggctaagccaagctgctctctcctccaaagggaggcagcctgtgtgctttgtccgtttgcctttgcagagacctcgatcttcacgcaaggcaagcagcagcccctgtaagcacacgagacaatcccaagtgtcagtgggaaggagatccctttcctgatggggctgcctgtgtccagtccctcccagcttccccagggccctggggctctgcaggcattcagaagtggaagccagccacagcctgggactgaagaggttaatgtgcatctgcctccgaatgttaatgtgtctaggtgatgtcagtgggagccatgaagaagggagtggggagggcagttgggcttggaggcggcagcggctgccaggctacggaggaagacccccttcccaactgcggggcttgcgctccgggacaaggtggcaggcgctggaggctgccgcagcctgcgtgggtggaggggagctcagctcggttgtgggagcaggcgaccggcactggctggatggacctggaagcctcgctgctgcccactggtcccaacgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctgatacttcccctgccaccctgcacacctccaagtcagggcaccacaacacgccaccgggagagatgctgagaaaaacccaagaccgctcgggaaatgcaggaaggccgggttgtgaggggttgttgcaatgaaataaatacattccatggggctcacacgttgctggggaggcctggagtcaggtttggggttttcagatatcagaaatccccttgggggagcaggatgagacctttggatagaacagaagctgagcaagagaacatgttggtttggataaccggttgcactatatctgtgagctctcaaatgtcttcttcccaaggcaagaggtggaagggtactgactgggtttgtttaaagtcaggcagggctggagtgagcagccagggccatgttgcacaaggcctgagagacgggaaagggcccgatcgctctttcccgcctctcactggtgcgatggaaggtggcctttctcccaagctggtggataatgaaaaataaagcatcccatctctcggcgttccagcatcctgtcaatttcccttttgctctagaggatgcatgtttatttgaggggatgtggcactgagcccacaggagtaaaagcccagtttgctaggaggtctgcttactgaaaacaaggagacctggggtgggtgtggttgggggtcttaaaactaataaaagctggggtcggggggcttttgcagctctggtgacattctctccacggggcacatttgctcagtcactaatccagcttgagtgtccgtgtgttctgcatgtgcaggggtcattctagtgcccggtgtgttggcatcatctttttgctctagcccttcctctccaaaataaaatcaaataaaggaaaatctccacccaca

SEQ ID NO: 17569 - DNA, 1219 bp, Homo sapiens
ccaagtgtcagtgggaaggagatccctttcctgatggggctgcctgtgtccagtccctcccagcttccccagggccctggggctctgcaggcattcagaagtggaagccagccacagcctgggactgaagaggttaatgtgcatctgcctccgaatgttaatgtgtctaggtgatgtcagtgggagccatgaagaagggagtggggagggcagttgggcttggaggcggcagcggctgccaggctacggaggaagacccccttcccaactgcggggcttgcgctccgggacaaggtggcaggcgctggaggctgccgcagcctgcgtgggtggaggggagctcagctcggttgtgggagcaggcgaccggcactggctggatggacctggaagcctcgctgctgcccactggtcccaacgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcgtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctgatacttcccctgccaccctgcacacctccaagtcagggcaccacaacacgccaccgggagagatgctgagaaaaacccaagaccgctcgggaaatgcaggaaggccgggttgtgaggggttgttgcaatgaaataaatacattccatggggctcac
